US009925260B2

(12) United States Patent
Robinson

(10) Patent No.: US 9,925,260 B2
(45) Date of Patent: Mar. 27, 2018

(54) TREATMENT FOR BONE DISEASES

(71) Applicant: UCB PHARMA S.A., Slough (GB)

(72) Inventor: Martyn Kim Robinson, Buckinghamshire (GB)

(73) Assignee: UCB PHARMA S.A., Slough (GB)

( * ) Notice: Subject to any disclaimer, the term of this patent is extended or adjusted under 35 U.S.C. 154(b) by 94 days.

(21) Appl. No.: 13/934,433

(22) Filed: Jul. 3, 2013

(65) Prior Publication Data

US 2014/0030268 A1  Jan. 30, 2014

Related U.S. Application Data

(60) Provisional application No. 61/668,210, filed on Jul. 5, 2012, provisional application No. 61/782,072, filed on Mar. 14, 2013.

(51) Int. Cl.

| A61K 39/395 | (2006.01) |
|---|---|
| C07K 16/18 | (2006.01) |
| C07K 16/22 | (2006.01) |
| A61K 45/06 | (2006.01) |
| A61K 33/42 | (2006.01) |
| A61K 39/00 | (2006.01) |

(52) U.S. Cl.
CPC .......... *A61K 39/3955* (2013.01); *A61K 33/42* (2013.01); *A61K 45/06* (2013.01); *C07K 16/22* (2013.01); *A61K 2039/505* (2013.01); *C07K 16/18* (2013.01); *C07K 2317/94* (2013.01)

(58) Field of Classification Search
None
See application file for complete search history.

(56) References Cited

U.S. PATENT DOCUMENTS

| 4,331,647 | A | 5/1982 | Goldenberg |
| 4,376,110 | A | 3/1983 | David et al. |
| 4,411,993 | A | 10/1983 | Gillis |
| 4,427,115 | A | 1/1984 | Laipply |
| 4,543,439 | A | 9/1985 | Frackelton, Jr. et al. |
| RE32,011 | E | 10/1985 | Zimmerman et al. |
| 4,837,440 | A | 6/1989 | Burtscher et al. |
| 4,902,614 | A | 2/1990 | Wakabayashi et al. |
| 5,070,108 | A | 12/1991 | Margolis |
| 5,145,684 | A | 9/1992 | Liversidge et al. |
| 5,223,409 | A | 6/1993 | Ladner et al. |
| 5,399,363 | A | 3/1995 | Liversidge et al. |
| 5,453,492 | A | 9/1995 | Butzow et al. |
| 5,466,468 | A | 11/1995 | Schneider et al. |
| 5,543,158 | A | 8/1996 | Gref et al. |
| 5,552,157 | A | 9/1996 | Yagi et al. |
| 5,565,213 | A | 10/1996 | Nakamori et al. |
| 5,567,434 | A | 10/1996 | Szoka, Jr. |
| 5,571,714 | A | 11/1996 | Dasch et al. |
| 5,627,052 | A | 5/1997 | Schrader et al. |
| 5,641,515 | A | 6/1997 | Ramtoola |
| 5,698,426 | A | 12/1997 | Huse |
| 5,738,868 | A | 4/1998 | Shinkarenko et al. |
| 5,780,263 | A | 7/1998 | Hastings et al. |
| 5,795,587 | A | 8/1998 | Gao et al. |
| 5,795,965 | A | 8/1998 | Tsuchiya et al. |
| 5,811,238 | A | 9/1998 | Stemmer et al. |
| 5,830,721 | A | 11/1998 | Stemmer et al. |
| 5,837,458 | A | 11/1998 | Minshull et al. |
| 5,877,397 | A | 3/1999 | Lonberg et al. |
| 6,015,801 | A * | 1/2000 | Daifotis et al. ............... 514/108 |
| 6,054,561 | A | 4/2000 | Ring |
| 6,057,421 | A | 5/2000 | Muller et al. |
| 6,117,911 | A | 9/2000 | Grainger et al. |
| 6,133,426 | A | 10/2000 | Gonzalez et al. |
| 6,180,370 | B1 | 1/2001 | Queen et al. |
| 6,207,153 | B1 | 3/2001 | Dan et al. |
| 6,395,511 | B1 | 5/2002 | Brunkow et al. |
| 6,489,445 | B1 | 12/2002 | Brunkow et al. |
| 6,495,736 | B1 | 12/2002 | Brunkow et al. |
| 6,703,199 | B1 | 3/2004 | Koide |

(Continued)

FOREIGN PATENT DOCUMENTS

| JP | 4-141095 | 5/1992 |
| WO | WO-91/13152 | 9/1991 |

(Continued)

OTHER PUBLICATIONS

Lewiecki, E. M., Expert Opin. Biol. Ther., 2006, vol. 6(10):1041-1050.*
A diagram of a relevant part of the human genome (D64), citation in Appeal, European Pat. No. 1133558, dated Apr. 15, 2010.
Abbas et. al. (Eds.), Cellular and Molecular Immunology, Third Edition, Section II, p. 54 (1997).
Alberts et. al. (Eds.), Molecular Biology of the Cell, Third Edition, Chapter 23, p. 1212 (1994).
Albertsen et. al., A physical map and candidate genes in the BRCA1 region on chromosome 17q12-21. *Nat. Genet.*, 7:472-9 (1994).
Alting-Mees et. al., Monoclonal antibody expression libraries: A rapid alternative to hybridomas. *Strat. Molec. Biol.*, 3:1-9 (1990).
Alves et. al., Sclerosteosis: A marker of Dutch ancestry? *Rev. Bras. Genet.*, 4:825-34 (1982).
Andersson et. al., Molecular genetics and pathophysiology of 17β-hydroxysteriod dehydrogenase 3 deficiency. *J. Clin. Endocrinol. Metab.*, 81(1): 130-6 (1996).

(Continued)

*Primary Examiner* — Xiaozhen Xie
(74) *Attorney, Agent, or Firm* — Marshall, Gerstein & Borun LLP

(57) ABSTRACT

The invention relates to the treatment of bone disorders. In particular, the invention is directed to the use of a dosing holiday to help overcome the resistance to anti-sclerostin antibodies which develops over time when a plurality of doses of antibody are given to a subject. By giving the subject to be treated such a dosing holiday, the subject may subsequently display an increased response to a subsequent dose of the anti-sclerostin antibody. The subject may be given multiple cycles of a batch of at least two doses of anti-sclerostin antibody and a dosing holiday. In some instances, the subject may be monitored to help determine when to give the dosing holiday. Further, the subject may be given a different treatment for the bone disorder during the dosing holiday from the anti-sclerostin antibody.

39 Claims, 204 Drawing Sheets

(56) References Cited

U.S. PATENT DOCUMENTS

| | | | |
|---|---|---|---|
| 6,803,453 B1 | 10/2004 | Brunkow et al. | |
| 6,806,055 B2 | 10/2004 | Berman et al. | |
| 6,815,201 B2 | 11/2004 | Pinter | |
| 6,818,748 B2 | 11/2004 | Fulton et al. | |
| 7,192,583 B2 | 3/2007 | Brunkow et al. | |
| 7,226,902 B2 | 6/2007 | Winkler et al. | |
| 7,381,409 B2 | 6/2008 | Winkler et al. | |
| 7,572,899 B2 | 8/2009 | Brunkow et al. | |
| 7,578,999 B2 | 8/2009 | Winkler et al. | |
| 7,592,429 B2 * | 9/2009 | Paszty et al. | 530/388.24 |
| 7,642,238 B2 | 1/2010 | Shaughnessy | |
| 7,744,874 B2 | 6/2010 | Korytko et al. | |
| 7,758,858 B2 | 7/2010 | Brunkow et al. | |
| 7,868,134 B2 | 1/2011 | Winkler et al. | |
| 7,872,106 B2 | 1/2011 | Paszty et al. | |
| 8,003,108 B2 | 8/2011 | Lu et al. | |
| 8,017,120 B2 | 9/2011 | Padhi et al. | |
| 8,178,099 B2 | 5/2012 | Ellies | |
| 2003/0166247 A1 | 9/2003 | Brunkow et al. | |
| 2003/0186915 A1 | 10/2003 | Pan et al. | |
| 2003/0229041 A1 | 12/2003 | Sutherland et al. | |
| 2004/0009535 A1 | 1/2004 | Brunkow et al. | |
| 2004/0023356 A1 | 2/2004 | Krumlauf et al. | |
| 2004/0058321 A1 | 3/2004 | Brunkow et al. | |
| 2004/0141875 A1 | 7/2004 | Doshi | |
| 2004/0146888 A1 | 7/2004 | Paszty et al. | |
| 2004/0158045 A1 | 8/2004 | Brunkow et al. | |
| 2005/0014650 A1 | 1/2005 | Seitz et al. | |
| 2005/0085418 A1 | 4/2005 | Winkler et al. | |
| 2005/0106683 A1 | 5/2005 | Winkler et al. | |
| 2005/0238646 A1 | 10/2005 | Ledbetter et al. | |
| 2006/0233801 A1 | 10/2006 | Brunkow et al. | |
| 2007/0072797 A1 | 3/2007 | Robinson et al. | |
| 2007/0110747 A1 | 5/2007 | Paszty et al. | |
| 2007/0292444 A1 | 12/2007 | Krumlauf et al. | |
| 2008/0182876 A1 | 7/2008 | Brunkow et al. | |
| 2008/0234219 A1 | 9/2008 | Brunkow et al. | |
| 2009/0074763 A1 * | 3/2009 | Padhi et al. | 424/133.1 |
| 2009/0117118 A1 | 5/2009 | Winkler et al. | |
| 2009/0304713 A1 | 12/2009 | Paszty et al. | |
| 2010/0015665 A1 | 1/2010 | Latham et al. | |
| 2010/0036091 A1 | 2/2010 | Robinson et al. | |
| 2010/0151524 A1 | 6/2010 | Winkler et al. | |
| 2011/0044978 A1 | 2/2011 | Ke et al. | |
| 2011/0097342 A1 | 4/2011 | Paszty et al. | |
| 2011/0150866 A1 | 6/2011 | Brunkow et al. | |

FOREIGN PATENT DOCUMENTS

| | | |
|---|---|---|
| WO | WO-92/01047 | 1/1992 |
| WO | WO-92/02551 | 2/1992 |
| WO | WO-92/06693 | 4/1992 |
| WO | WO-95/30003 | 11/1995 |
| WO | WO-96/04375 | 2/1996 |
| WO | WO-98/21335 | 5/1998 |
| WO | WO-99/03996 | 1/1999 |
| WO | WO-99/06554 | 2/1999 |
| WO | WO-99/15556 | 4/1999 |
| WO | WO-00/32773 | 6/2000 |
| WO | WO-00/44777 | 8/2000 |
| WO | WO-00/75317 | 12/2000 |
| WO | WO-01/64885 | 9/2001 |
| WO | WO-01/92308 | 12/2001 |
| WO | WO-01/98491 | 12/2001 |
| WO | WO-02/24888 | 3/2002 |
| WO | WO-02/30463 | 4/2002 |
| WO | WO-03/050513 | 6/2003 |
| WO | WO-03/087763 | 10/2003 |
| WO | WO-03/106657 | 12/2003 |
| WO | WO-2004/082608 | 9/2004 |
| WO | WO-2004/094477 | 11/2004 |
| WO | WO-2004/098491 | 11/2004 |
| WO | WO-2005/003158 | 1/2005 |
| WO | WO-2005/014650 | 2/2005 |
| WO | WO-2005/115356 | 12/2005 |
| WO | WO-2006/015373 | 2/2006 |
| WO | WO-2006/065746 | 6/2006 |
| WO | WO-2006/102070 | 9/2006 |
| WO | WO-2006/119062 | 11/2006 |
| WO | WO-2006/119107 | 11/2006 |
| WO | WO-2007/080129 | 7/2007 |
| WO | WO-2008/061013 | 5/2008 |
| WO | WO-2008/092894 | 8/2008 |
| WO | WO-2008/115732 | 9/2008 |
| WO | WO-2008/133722 | 11/2008 |
| WO | WO-2009/039175 | 3/2009 |
| WO | WO-2009/047356 | 4/2009 |
| WO | WO-2009/056634 | 5/2009 |
| WO | WO-2009/079471 | 6/2009 |
| WO | WO-2009/131553 | 10/2009 |
| WO | WO-2009/149189 | 12/2009 |
| WO | WO-2010/100179 | 9/2010 |
| WO | WO-2010/100200 | 9/2010 |
| WO | WO-2010/115932 | 10/2010 |
| WO | WO-2010/130830 | 11/2010 |
| WO | WO-2012/028683 | 3/2012 |
| WO | WO-2012/058393 | 5/2012 |

OTHER PUBLICATIONS

Angal et. al., A single amino acid substitution abolishes the heterogeneity of chimeric mouse/human (IgG4) antibody. *Mol. Immunol.*, 30(1):105-8 (1993).

Annex EW6 to Declaration filed in connection with the European Patent EP 1133558 Opposition, Expert opinion of Prof. Dr. Edgar Wingender, dated Sep. 24, 2009.

Annex regarding the purported relevance of gene/peptides mentioned by Professor Arnett.

Anonymous, Amgen presents denosumab and sclerostin antibody data at American Society for Bone and Mineral Research Annual Meeting. Amgen Media Press Release. <www.amgen.com/media/media_pr_detail.jsp?releaseID=907028> (2006).

Anonymous, UCB on track. UCB News <http://hugin.info/133973/R/1176122/233395.pdf> (2007).

Arnett et. al., Effect of pH on bone resorption by rat osteoclasts in vitro. *Endocrinol.*, 119(1): 119-124 (1986).

Attana Application Example, cited in Opposition against European Patent No. 1721979 by Opponent: Novartis AG, dated Jun. 15, 2011.

Avsian-Kretchmer et. al., Comparative genomic analysis of the eight-membered ring cystine knot-containing bone morphogenetic protein antagonists. *Molec. Endocrinol.*, 18(1):1-12 (2004).

Babcook et. al., A novel strategy for generating monoclonal antibodies from single, isolated lymphocytes producing antibodies of defined specificities. *Proc. Natl. Acad. Sci. USA*, 93:7843-8 (1996).

Baines et. al., Purification of immunoglobulin G (IgG). *Meth. Molec. Biol.*, 10:79-104 (1992).

Balemans et. al., Extracellular regulation of BMP signaling in vertebrates: A cocktail of modulators. *Dev. Biol.*, 250:231-50 (2002).

Balemans et. al., Increased bone density in sclerosteosis is due to the deficiency of a novel secreted protein (SOST). *Hum. Mol. Genet.*, 10:537-43 (2001).

Balemans et. al., Localization of the gene for sclerosteosis to the van Buchem disease-gene region on chromosome 17q12-q21. *Am. J. Hum. Genet.*, 64:1661-9 (1999).

Balint et. al., Antibody engineering by parsimonious mutagenesis. *Gene*, 137(1):109-18 (1993).

Bateman et. al., Granulins: The structure and function of an emerging family of growth factors. *J. Endocrinol.*, 158: 145-51 (1998).

Baxevanis (Ed.) et. al., Bioinformatics: A practical guide to the analysis of genes and proteins, John Wiley & Sons, Inc. p. 234 (1998).

Beighton et. al., Heterozygous manifestations in the heritable disorders of the skeleton. *Pediatr. Radiol.*, 27: 397-401 (1997).

Beighton et. al., The clinical features of sclerosteosis. *Clin. Genet.*, 25:175-81 (1984).

Beighton et. al., The syndromic status of sclerosteosis and van Buchem disease. *Ann. Intern. Med.*, 84:393-7 (1976).

(56) References Cited

OTHER PUBLICATIONS

Bellows et. al., Parathyroid hormone reversibly suppresses the differentiation of osteoprogenitor cells in functional osteoblasts. *Endocrinol.*, 127(6): 3111-6 (1990).
Bendayan, Possibilities of false immunocytochemical results generated by the use of monoclonal antibodies: The example of the anti-proinsulin antibody. *J. Histochem. Cytochem.*, 43(9):881-6 (1995).
Bendig, Humanization of rodent monoclonal antibodies by CDR grafting. *Methods*, 8:83-93 (1995).
Bergfeld et. al., Release of ATP from human erythrocytes in response to a brief period of hypoxia and hypercapnia. *Cardiovascular Res.*, 26: 40-7 (1992).
Berman et. al., The protein data bank. *Acta. Cryst.*, 58(1):899-907 (2002).
Bigger versions of Figures from Declaration of Professor Teresa Attwood, citation in Appeal, European Patent No. 1133558, dated Apr. 13, 2010.
Bird et. al., Single-chain antigen-binding proteins. *Science*, 242:423-6 (1988).
Birren et. al., EMBL sequence database accession No. AC003098.2, Nov. 14, 1997.
Bishop (Ed.), Guide to Human Genome Computing, Second Edition, Academic Press, Chapter 1: Introduction to human genome computer via the world wide web, pp. 1-14 (2003).
Black et. al., A somatic cell hybrid map of the long arm of human chromosome 17, containing the familial breast cancer ILocus (BRCAI). *Am. J. Hum. Genet.*, 52:702-10 (1993).
Blum et. al., Study plan for German students in the summer of 1998, University Bioinformatik lecture announcement (1998).
Boden et. al., Glucocorticoid-induced differentiation of fetal rat calvarial osteoblasts is mediated by bone morphogenetic protein-6. *Endocrinology*, 138(7):2820-8 (1997).
Boerner et. al., Production of antigen-specific human monoclonal antibodies from in vitro-primed human splenocytes. *J. Immunol.*, 147:86-95 (1991).
Bonaldo et. al., EMBL Sequence Database Accession No. AI113131, Sep. 4, 1998.
Bonaldo et. al., Normalization and subtraction: Two approaches to facilitate gene discovery. *Genome Res.*, 6(9):791-806 (1996).
Bondestam, Ligands & Signaling Components of the Transforming Growth Factor, Helsinki University Biomedical Dissertations (2002).
Bork et. al., Go hunting in sequence databases by watch out for the traps. *Trends Genet.*, 12: 425-7 (1996).
Bos et. al., Ras ongogenes in human cancer: A review. *Cancer Res.*, 49: 4682-9 (1989).
Bost et. al., Antibodies against a peptide sequence within the HIV envelope protein crossreacts with human interleukin-2. *Immunol. Invest.*, 17(6&7):577-86 (1988).
Bostrom et. al., Ligand and signaling components of the transforming growth factor β family. *J. Orth. Res.*, 13:357-67 (1995).
Bottcher et. al., NCBI Sequence database accession No. NM_004329, Aug. 2, 2009.
Bouffard et. al., A physical map of human chromosome 7: An integrated YAC contig map with average STS spacing of 79 kb. *Genome Res.*, 7: 673-92 (1997).
Bowie et. al., A method to identify protein sequences that fold into a known three-dimensional structure. *Science*, 253:164-70 (1991).
Bowie et. al., Deciphering the message in protein sequences: Tolerance to amino acid substitutions. *Science*, 247(4948):1306-10 (1990).
Bradley et. al., Modifying the mouse: Design and desire. *Bio/Technology*, 10:534-9 (1992).
Brandao-Burch et. al., Acidosis inhibits bone formation by osteoblasts in vitro by preventing mineralization. *Calcif. Tissue Int.*, 77: 167-74 (2005).
Brenner et. al., Population statistics of protein structures: Lessons from structural classifications. *Curr. Op. Struct. Biol.*, 7(3):369-76 (1997).
Brown, Hybridization analysis of DNA blots, *Current Protocols in Protein Science*, 13:A.4H.1-A.4H.9 (1990).
Brown, Hybridization analysis of DNA blots, *Current Protocols in Protein Science*, 2.10.1-2.10.16 (2000).
Bruggemann et. al., Production of human antibody repertoires in transgenic mice. *Curr. Opin. Biotechnol.*, 8:455-8 (1997).
Brunkow et. al., Bone dysplasia sclerosteosis results from loss of the SOST gene product, a novel cysteine knot-containing protein. *Am. J. Hum. Genet.*, 68:577-89 (2001).
Burton et. al., Human antibodies from combinatorial libraries. *Adv. Immunol.*, 57:191-280 (1994).
Butcher et. al., Increased salt concentration reversibly destabilizes p53 quaternary structure and sequence-specific DNA binding. *Biochem. J.*, 298: 513-6 (1994).
Byrne et. al., CD4+CD45RBHi T cell transfer induced colitis in mice is accompanied by osteopenia which is treatable with recombinant human osteoprotegerin. *Gut.*, 54:78-86 (2005).
Campbell et. al., Totipotency or multipotentiality of cultured cells: Applications and progress. *Theriogenology*, 47:63-72 (1997).
Caverzasio et. al., Characteristics and regulation of Pi transport in osteogenic cells for bone metabolism. *Kindey Int.*, 49: 975-80 (1996).
Chan et. al., A new paradigm in the treatment of osteoporosis: Wnt pathway proteins and their antagonists. *Curr. Opin. Invest. Drugs*, 8:293-8 (2007).
Chandran et. al., Recent trends in drug delivery systems: Liposomal drug delivery system—Preparation and characterization. *Indian J. Exp. Biol.*, 35(8):801-9 (1997).
Charlier et. al., A pore mutation in a novel KQT-like potassium channel gene in an idiopathic epilepsy family. *Nat. Genet.*, 18:53-5 (1998).
Chenu et. al., Glutamate receptors are expressed by bone cells and are involved in bone resorption. *Bone*, 22(4): 295-9 (1998).
Chou et. al., Empirical predication of protein conformation. *Ann. Rev. Biochem.*, 47:251-76 (1979).
Chou et. al., Prediction of the secondary structure of proteins from their amino acid sequence. *Adv. Enzymol. Relat. Areas Mol. Biol.*, 47:145-8 (1978).
Clark, Antibody humanization: A case of the 'Emperor's New Clothes'?. *Immunology Today*, 21(8):397-402 (2000).
Cogan et. al., NCBI Sequence Database Accession No. NM_033346, Jul. 19, 2005.
Collins, Identifying human disease genes by positional cloning. The Harvey Lectures, Series 86:149-64 (1992).
Collins, Positional cloning moves from perditional to traditional. *Nat. Genet.*, 9:347-50 (1995).
Colman, Effects of amino acid sequence changes on antibody-antigen interactions. *Biomolec. Res. Inst.*, 55:33-6 (1994).
Communication from the European Patent Office providing an "Observation by a Third Party according to Article 115 EPC" submitted in connection with the Opposition to European Pat. No. 1 133 558, dated Dec. 3, 2008.
Cook et. al., Structural basis for a functional antagonist in the transforming growth factor βsuperfamily. *J. Biol. Chem.*, 280(48):40177-86 (2005).
Cormier, Markers of bone metabolism. *Curr. Opin. in Rheu.*, 7:243-8 (1995).
Couvreur et. al., Polyalkylcyanoacrylates as colloidal drug carriers. *Crit. Rev. Ther. Drug Carrier Syst.*, 5(1):1-20 (1988).
Craig et. al., Sclerostin binds and regulates the activity of cysteine rich protein 61. *Biochem. Biophys. Res. Commun.*, 293(1): 36-40 (2010).
Craig et. al., Sclerostin-erbB-3 interactions: Modulation of erbB-3 activity by sclerostin. *Biochem. Biophys. Res. Commun.*, 402: 421-4 (2010).
Crameri et. al., DNA shuffling of a family of genes from diverse species accelerates directed evolution. *Nature*, 391 :288-91 (1998).
Dall'Acqua et. al., Antibody humanization by framework shuffling. *Methods*, 36(1):43-60 (2005).
Davies, et. al., Affinity improvement of single antibody VH domains: Residues in all three hypervariable regions affect antigen binding. *Immunotechnology*, 2(3): 169-79 (1996).

(56) References Cited

OTHER PUBLICATIONS de Jong et. al., Evolution of the α-crystallin/small heat-shock protein family. *Mol. Biol. Evol.*, 10(1): 103-26 (1993).
Dean et. al., Matrix vesicles produced by osteoblast-like cells in culture become significantly enriched in proteoglycan-degrading metalloproteinases after addition of β-glycerophosphate and ascorbic acid. *Calcif. Tissue*, 54: 399-408 (1994).
Declaration filed in connection with the European Patent EP 1133558 Opposition, Expert opinion of Dr. Auristela Freire de Paes Alves, Ph.D., dated Sep. 9, 2009.
Declaration filed in connection with the European Patent EP 1133558 Opposition, Expert opinion of Dr. Walter Sebald, dated Sep. 24, 2009.
Declaration filed in connection with the European Patent EP 1133558 Opposition, Expert opinion of Prof. Dr. Edgar Wingender, dated Sep. 24, 2009.
Declaration filed in connection with the European Patent EP 1133558 Opposition, Expert opinion of Prof. Dr. Thomas Muller, dated Sep. 23, 2009.
Declaration of Alistair J. Henry, citation in Appeal, European Patent No. 1133558, dated Apr. 2, 2010.
Declaration of Dr. Martyn Robinson, submitted in Opposition to European Patent No. 1133558.
Declaration of Dr. Mary E. Brunkow, submitted in Opposition to European Patent No. 1133558.
Declaration of Dr. Raymond Dalgleish dated Dec. 8, 2011, citation in Appeal, European Patent No. 1133558.
Declaration of Prof. Edgar Wingender filed in connection with that Opposition regarding European Patent EP 1133558 B1, dated Mar. 10, 2011.
Declaration of Professor Teresa Attwood, citation in Appeal, European Patent No. 1133558, dated Apr. 13, 2010.
Declaration of Tim Arnett, citation in Appeal, European Patent No. 1133558, dated Apr. 2, 2010.
Delmas et. al., The use of biochemical markers of bone turnover in osteoporosis. *Osteoporosis International*, Suppl. 6:S2-17 (2000).
Diagram of the candidate interval, citation by Propriator in Opposition against European Patent No. 1721979 on Feb. 20, 2012.
Ducy et. al., 5-HT and bone biology. *Curr. Opin. Pharmacol.*, 11 : 34-8 (2011).
Ducy et. al., Genetic control of cell differentiation in the skeleton. *Curr. Opin. Cell Biol.*, 10: 614-9 (1998).
Durham et. al., Alterations in insulin-like growth factor (IGF)-dependent IGF-binding protein-4 proteolysis in transformed osteoblastic cells. *Endocrinology*, 136(4):1374-80 (1995).
Ebara et. al., Mechanism for the action of bone morphogenetic proteins and regulation of their activity. *Spine*, 27(165):S10-5 (2002).
Eddleston et al., A short treatment with an antibody to sclerostin can inhibit bone loss in an ongoing model of colitis., *J. Bone Miner. Res.*, 24:1662-71 (2009).
Eli Lilly Statement of Grounds of Appeal, Opposition to European Patent Application No. 1133558 B1, dated Sep. 28, 2009.
Eli Lilly, Biacore experiment comparison results, Setup assay to measure BMP binding to captured SOST, referenced on p. 41 of reference C193, dated Sep. 28, 2009.
Epstein et. al., Endocrine function in sclerosteosis. *S. Afr. Med. J.*, 55:1105-10 (1979).
European Patent Office Communication, Opposition to European Patent No. 1133558, dated Nov. 4, 2008.
European Patent Office, "Opinion of the Enlarged Board of Appeal dated Dec. 1992 G 1/92", available from [http://documents.epo.org/projects/babylon/eponet.nsf/0/907016FA57B46FD0C12572C8006CD2E2/$File/g920001.pdf], cited Jun. 15, 2011.
Expert Opinion from Dr. Catalina Lopez-Correa, submitted in Opposition to European Patent No. 1133558, dated Mar. 6, 2009.
Expert opinion of Professor Dr.-Ing Ulrich Vollrath, citation in Appeal of European Patent No. 1133558, dated Apr. 12, 2005.

Extract from Sigma Aldrich catalogue, cited in Opposition against European Patent No. 1721979 by Opponent: Laudens, dated Jun. 15, 2011.
Eyre et. al., Characterization of aromatase and 17β-hydroxysteroid dehydrogenase expression in rat osteoblastic cells. *J. Bone Miner. Res.*, 13(6): 996-1004 (1998).
Foster et. al., Establishment of interference in osteoblasts by an osteopetrosis-inducing Avian Leukosis virus. *Virology*, 205: 376-8 (1994).
Fouser et. al., Feedback regulation of collagen gene expression: A Trojan horse approach. *Proc. Natl. Acad. Sci. USA*, 88: 10158-62 (1991).
Frost et. al., On the rat model of human osteopenias and osteoporoses. *Bone and Mineral*, 18:227-36 (1992).
Fujiwara et. al., GenBank Sequence Database Accession No. D79813, Feb. 9, 1996.
Gardner et. al., Bone mineral density in sclerosteosis; Affected individuals and gene carriers. *J. Clin. Endocrinol. Metab.*, 90(12): 6392-5 (2005).
Gavarini et. al., Opposite effects of PSD-95 and MPP3 PDZ proteins on serotonin 5-hydroxytryptamine2C receptor desensitization and membrane stability. *Molec. Biol.*, 17: 4619-31 (2006).
Gazzerro et. al., Bone morphogenetic proteins induce the expression of noggin which limits their activity in cultured rat osteoblasts. *J. Clin. Invest.*, 102(12):2106-14 (1998).
Gazzerro et. al., Potential drug targets within bone morphogenetic protein signaling pathways. *Curr. Opin. Pharmacol.*, 7: 325-3 (2007).
Geissler et la., Male pseudohermaphroditism caused by mutations of testicular 17β-hydroxysteroid hehydrogenase 3. *Nat. Genetics*, 7: 34-9 (1994).
Gencic et. al., Conservative amino acid substitution in the myelin proteolipid protein of Jimpymsd mice. *J. Neurosci.*, 10(1):117-24 (1990).
Geysen et. al., Cognitive features of continuous antigenic determinants. *J. Molec. Recog.*, 1(1):32-41 (1988).
Gitelman et. al., Vgr-1/BMP-6 induces osteoblastic differentiation of pluripotential mesenchymal cells. *Cell Growth & Differentiation*, 6:827-36 (1995).
Glasky et. al., Stability of specific immunoglobulin secretion by EBV-transformed lymphoblastoid cells and human-murine heterohybridomas. *Hybridoma*, 8:377-89 (1989).
Gowen et. al., Actions of recombinant human γ-interferon and tumor necrosis factor α on the proliferation and osteoblastic characteristics of human trabecular bone cells in vitro. *Arthritis Rheumatism*, 31(12): 1500-7 (1988).
Graner et. al., Splice variants of the Drosophila PS2 integrins differentially interact with RGD-containing fragments of the extracellular proteins tiggrin, Ten-m and D-laminin α2. *J. Biol. Chem.*, 273(29): 18235-41 (1998).
Green et al., Cytosolic pH regulation in osteoblasts. *J. Gen. Physiol.*, 95: 121-45 (1990).
Green et. al., Antigen-specific human monoclonal antibodies from mice engineered with human Ig heavy and light chain YACs. *Nat. Genet.*, 7:13 (1994).
Greene et. al., Screening Recombinant DNA Libraries. *Current Protocols in Molecular Biology*, Ch. 6(1) (1990).
Gribskov et. al., Profile analysis. *Meth. Enzym.*, 183:146-59 (1990).
Gribskov et. al., Profile analysis: Detection of distantly related proteins. *Proc. Nat. Acad. Sci. USA*, 84(13):4355-8 (1987).
Groeneveld et. al., Bone morphogenetic proteins in human bone regeneration. *Eur. J. Endocrinol.*, 142:9-21 (2000).
Gronthos et. al., Integrin expression and function on human osteoblast-like cells. *J. Bone Miner. Res.*, 12(8): 1189-97 (1997).
Groppe et. al., Structural basis of BMP signalling inhibition by the cystine knot protein noggin. *Nature*, 420:636-42 (2002).
Guinness-Hey, Increased trabecular bone mass in rats treated with human synthetic parathyroid hormone. *Metab. Bone Dis. Relat. Res.*, 5:177-81 (1984).
Harlow et. al., Antibodies: A Laboratory Manual, Cold Spring Harbor Laboratory, 141-157 (1988).

(56) References Cited

OTHER PUBLICATIONS

Harris, Processing of C-terminal lysine and arginine residues of proteins isolated from mammalian cell culture. *J. Chromatogr.*, 705:129-34 (1995).
Hart et. al., Crystal structure of the human TβR2 ectodomain-TGF-β3 complex. *Nat. Struc. Biol.*, 9(3):203-8 (2002).
Hay et. al., ATCC Cell Line and Hybridomas, American Type Culture Collection, 8th Ed., pp. 149, 258, 428 (1994).
He et. al., High-throughput dynamic light scattering method for measuring viscosity of concentrated protein solutions. *Anal. Biochem.*, 399(1): 141-3 (2010).
Heinecke et. al., Receptor oligomerization and beyond: A case study in bone morphogenetic proteins, *BMC Biol.*, 7: 59 (2009).
Hill et. al., Multiple extracellular signals promote osteoblast survival and apoptosis. *Endocrinology*, 138(9):3849-58 (1997).
Hillier et. al., EMBL Sequence Database Accession No. AA393939, May 19, 1997.
Hillier et. al., GenBank Sequence Database Accession No. AA393768, Apr. 24, 1997.
Hillier et. al., Generation and analysis of 280,000 human expressed sequence tags. *Genome Res.*, 6: 807-28 (1996).
Hilliker et. al., Truncation of the amino terminus of PTH alters its anabolic activity on bone in vivo. *Bone*, 19(5): 469-77 (1996).
Hirschhorn, Letter to the editor: Dominance and homozygosity in man. *Am. J. Med. Genetics*, 18: 541 (1984).
Hock et. al., Perspective: Osteoblast apoptosis and bone turnover. *J. Bone Miner. Res.*, 16(6):975-84 (2001).
Hoffman et. al., BMP Signaling Pathways in Cartilage and Bone Formation, *Crit. Rev. Eukaryotic Gene Exp.*, 11(1-3):23-45 (2001).
Hoggard et. al., Localization of leptin receptor mRNA splice variants in murine peripheral tissues by RT-PCR and in situ hybridization. *Biochem. Biophys. Res. Commun.*, 232: 383-7 (1997).
Hollinger et. al., Engineered antibody fragments and the rise of single domains. *Nat. Biotech.*, 23(9):1126-36 (2005).
Holm et. al., Protein folds and families: Sequence and structure alignments. *Nucl. Acid Res.*, 27(1):244-7 (1999).
Holt, et. al., Domain antibodies: Proteins for therapy. *Trends Biotechnol.*, 21(11):484-90 (2003).
Hoogenboom et. al., By-passing immunisation: Human antibodies from synthetic repertoires of germline VH gene segmens rearranged in vitro. *J. Molec. Biol.*, 227:381-8 (1992).
Hoogewerf et. al., Glycosaminoglycans mediate cell surface oligomerization of chemokines. *Biochemistry*, 36: 13570-8 (1997).
Horton et. al., Arg-Gly-Asp (RGD) peptides and the anti-vitronectin receptor antibody 23C6 inhibit dentine resorption and cell spreading by osteoclasts. *Exp. Cell Res.*, 195: 368-75 (1991).
Hsu et. al.,The Xenopus dorsalizing factor gremlin indentified a novel family of secreted proteins that antagonize BMP activities. *Molec. Cell*, 1:673-83 (1998).
Hufner et. al., Evidence for an osteoblast-activating factor in a patient with peripheral T-cell lymphoma and osteosclerosis. *Klin. Wochenscher.*, 67: 402-7 (1989).
Hulley et. al., Inhibition of mitogen-activated protein kinase activity and proliferation of an early osteoblast cell line (MBA 15.4) by dexamethasone: Role of protein phosphatases. *Endocrinol.*, 139(5): 2423-31 (1998).
Huse et. al., Generation of a large combinatorial library of the immunoglobulin repertoire in phage lambda. *Science*, 246:1275-81 (1989).
Hwang et. al., Use of human germline genes in a CDR homoloy-based approach to antibody humanization. *Methods*, 36(1):35-42 (2005).
Ide et. al., GenBank Sequence Database Accession No. BAA19765, Feb. 7, 1999.
Ide et. al., GenBank Sequence Datacase Accession No. D89675, Feb. 7, 1999.
Iemura et. al., Direct binding of follistatin to a complex of bone-morphogenetic protein and its receptor inhibits ventral and epidermal cell fates in early Xenopus embryo. *Proc. Natl. Acad. Sci. USA*, 95:9337-42 (1998).
Innis et. al., Evolutionary trace analysis of TGF-B and related growth factors: Implications for stie-directed mutagenesis. *Protein Engineering*, 13(12):839-47 (2000).
Jakobovits et. al., Production of antigen-specific human antibodies from mice engineered with human heavy and light chain YACsa. *Ann. N.Y. Acad. Sci.*, 764:525-35 (1995).
Jee et. al., Overview: Animal models of osteopenia and osteoporosis. *J. Musculoskel. Neuron. Interact.*, 1:193-207 (2001).
Jilka et. al., Increased bone formation by prevention of osteoblast apoptosis with parathyroid hormone. *J. Clin. Invest.*, 104:439-46 (1999).
Jilka et. al., Osteoblast programmed cell death (apoptosis): Modulation by growth factors and cytokines. *J. Bone Miner. Res.*, 13(5): 793-802 (1998).
Jones, Progress in protein structure predication. *Curr. Opin. Struct. Biol.*, 7(3):377-387 (1997).
Kabat et. al., Sequences of proteins of immunological interest, U.S. Department of Health and Human Services, *NIH, USA* (1987) (Table of Contents).
Kalu, The ovariectomized rat model of postmenopausal bone loss. *Bone and Mineral*, 15:175-92 (1991).
Kang et. al., Linkage of recognition and replication functions by assembling combinatorial antibody Fab libraries along phage surfaces. *Proc. Natl. Acad. Sci. USA*, 88:4363-6 (1991).
Katagiri et. al., The non-osteogenic mouse pluripotent cell line, C3H10T1/2, is induced to differentiate into osteoblastic cells by recombinant human bone morphogenetic protein-2. *Biochem. Biophys. Res. Comm.*, 172(1):295-9 (1990).
Kawabata et. al., Signal transduction by bone morphogenetic proteins. *Cytokine and Growth Factor Reviews*, 9(1):49-61 (1998).
Keller et. al., Molecular recognition of BMP-2 and BMP receptor IA. *Nat. Struct. Mol. Biol.*, 11(5):481-488 (2004).
Khalil, TGF-β: From latent to active. *Microbes and Infection*, 1(15):1255-63 (1999).
Khosla et. al., Concise review for primary-care physicians. Treatment pptions for osteoporosis. *Mayo Clin. Proc.*, 70:978-82 (1995).
Kirsch et. al., BMP-2 antagonists emerge from alterations in the low-affinity binding epitope for receptor BMPR-II, *Embo J.*, 19(13): 3314-24 (2000).
Kohler et. al., Continuous cultures of fused cells secreting antibody of predefined specificity. *Nature*, 256:495 (1975).
Koli et. al., Latency, activation, and binding proteins of TGF-. *Microscopy Res. Tech.*, 52:354-62 (2001).
Koreth et. al., Microsatellites and PCR genomic analysis. *J. Pathology*, 178:239-48 (1996).
Kramer et. al., The gapped duplex DNA approach to oligonucleotide-directed mutation construction. *Nuc. Acids Res.*, 12:9441 (1984).
Krause et. al., Distinct modes of inhibition by sclerostin on bone morphogenetic protein and Wnt signaling pathways. *J. Biol. Chem.*, 285(53): 41614-26 (2010).
Kunkel et. al., Rapid and efficient site-specific mutagenesis without phenoypic selection. *Meth. Enzymol.*, 154:367-82 (1987).
Kunkel, Rapid and efficient site-specific mutagenesis without phenotypic selection. *Proc. Natl. Acad. Sci. USA*, 82:488-92 (1985).
Kurahashi et. al., Regions of genomic instability on 22q11 and 11q23 as the etiology for the recurrent constitutional t (11;22). *Hum. Molec. Genet.*, 9: 1665-70 (2000).
Kusu et. al., Sclerostin is a novel secreted osteoclast-dervied bone morphogenetic protein antagonist with unique ligand specificity. *J. Biol. Chem.*, 278:24113-7 (2003).
Labat et. al., Retroviral expression in mononuclear blood cells isolated from a patient with osteopetrosis (Albers-Schonberg disease). *J. Bone Miner. Res.*, 5(5): 425-35 (1989).
Labat, A new approach to the study of the origin of genetic disease: Retroviral etiology of osteopetrosis. *Biomed. Pharmacother.*, 45: 23-7 (1991).
Lasic, Novel applications of liposomes. *Trends Biotechnol.*, 16(7):307-21 (1998).
Latham, The biochemical and cellular characterization of sclerostin, The causative gene for sclerostenosis. *Calcified Tissue International*, 70(4):244 (2002).

(56) References Cited

OTHER PUBLICATIONS

Leppert et. al., Benign familial neonatal epilepsy with mutations in two potassium channel genes. *Curr. Opin. Neurol.*, 12: 143-7 (1999).
Lewiecki et. al., Sclerostin monoclonal antibody therapy with AMG 785: A potential treatment for osteoporosis. *Exp. Opin. Biol. Ther.*, 11(1): 117-27 (2011).
Li et. al., Sclerostin binds to LRP5/6 and antagonizes canonical Wnt signaling. *J. Biol. Chem.*, 280: 19883-7 (2005).
Li et. al., Treatment with an anti-sclerostin antibody directly stimulates bone formation in a dose-dependent manner in ovariectomized rats with established osteopenia. *J. Bone Min. Res.*, 22(Suppl. S1): S65 (2007).
Lian et. al., Bone Formation: Osteoblast Lineage Cells, Growth Factors, Matrix Proteins, and the Mineralization Process, Primer on the Metabolic Bone Diseases and Disorders of Mineral Metabolism, 4th Edition, 14-29 (1999).
Lierop et. al., Van Buchem disease: Clinical, biochemical and densitometric features of patients and disease carriers. *J. Bone Miner. Res. Accepted Article* (2012).
Liu et. al., GenBank Sequence Database Accession No. U25110, Feb. 2, 1996.
Liu et. al., Human type II receptor for bone morphogenic proteins (BMPs): Extension of the two-kinase receptor model to the BMPs. *Molec. Cell. Biol.*, 15(7):3479-86 (1995).
Lonberg et. al., Antigen-specific human antibodies from mice comprising four distinct genetic modifications. *Nature*, 368:856 (1994).
Loots et. al., Genomic deletion of a long-range bone enhancer misregulates sclerostin in Van Buchem disease. *Genome Res.*, 15: 928-35 (2005).
Low et. al., Mimicking somatic hypermutation: Affinity maturation of antibodies displayed on bacteriophage using a bacterial mutator strain. *J. Mol. Biol.*, 250:350-68 (1996).
Lowik et. al., Wnt signaling is involved in the inhibitory action of sclerostin on BMP-stimulated bone formation. *J. Musculoskeleton Neuronal Interact.* 6: 357 (2006).
Luckman et. al., Heterocycle-containing bisphosphonates cause apoptosis and inhibit bone resorption by preventing protein prenylation: Evidence from structure-activity relationships in J774 macrophages. *J. Bone Miner. Res.*, 13(11): 1668-78 (1998).
Luckman et. al., Nitrogen-containing bisphosphonates inhibit the mevalonate pathway and prevent post-translational prenylation of GTP-binding proteins, including Ras. *J. Bone Miner. Res.*, 13(4): 581-9 (1998).
Malone et. al., Bone anabolism achieved by reducing sclerostin bioavailability with an anti-sclerostin antibody. 37th International Sun Valley Workshop on Skeletal Tissue Biology. Aug. 5-8, 2007.
Mango et. al., Carboxy-terminal truncation activates glp-1 protein to specify vulval fates in Caenorhabditis elegans. *Lett. Nature*, 352: 811-15 (1991).
Margalit et. al., Comparative analysis of structurally defined herparin binding sequences reveals a distinct spatial distribution of basic residues. *J. Biol. Chem.*, 268 (26): 19228-31 (1993).
Margalit, Liposome-mediated drug targeting in topical and regional therapies. *Crit. Rev. Ther. Drug Carrier Syst.*, 12(2-3):233-61 (1995).
Marks et. al., By-passing immunization: Building high affinity human antibodies by chain shuffling. *Bio/Technology*, 10:779-83 (1992).
Matthews et. al., Adenovirus protein-protein interactions: Hexon and protein VI. *J. Gen. Virol.*, 75: 3365-74 (1994).
Mayer et. al., Differentiation of osteogenetic cells: Systems and regulators, Z. *Orthop.*, 130: 276-84 (1992)—Abstract Only.
McClung et. al., Inhibition of sclerostin with AMG 785 in postmenopausal women with low bone mineral density: Phase 2 trial results—Abstract presented at the 2012 meeting of the American Society for Bone and Mineral Reasearch (2012).
Memorandum C, Munich Diplomatic Conference, Sep. 1 to Oct. 6, 1973.

Minabe-Saegusa et. al., Genbank Sequence Database Accession No. AB011030, Jun. 23, 1998.
Minutes of the oral proceedings before the opposition division for Opposition against European Patent No. 1721979, dated May 10, 2013.
Miyazono et. al., Divergence and convergence of TGF-β/BMP signaling. *J. Cell. Physiol.*, 187:265-76 (2001).
Miyazono et. al., TGF-β signaling by Smad proteins. *Adv. Immunology*, 75:115-57 (2000).
Morais et. al., In vitro biomineralization by osteoblast-like cells I. Retardation of tissue mineralization by metal salts. *Biomaterials*, 19: 13-21 (1998).
Mori et. al., A novel amino acid substitution a the receptor-binding site on the hemaglutinin of H3N2 influenza A viruses isolated from 6 cases with acute encephalopathy during 1997-1998 season in Tokyo. *Arch. Virol.*, 144: 147-55 (1999).
Morrison et. al., ATP is a potent stimulator of the activation and formation of rodent osteoclasts. *J. Physiol.*, 511.2: 495-500 (1998).
Mosekilde et. al., Assessing bone quality—Animcal models in preclininical osteoporosis research. *Bone*, 17 (4): 343S-52S (1995).
Moult, The current state of the art in protein structure predicion. *Curr. Opin. Biotech.*, 7(4):422-7 (1996).
Mullins et. al., Perspectives series: Molecular medicine in genetically engineered animals; Transgenesis in the rat and larger mammals. *J. Clin. Invest.*, 97(7):1557-60 (1996).
Muntoni et. al., A mutation in the dystrophin gene selectively affecting dystrophin expression in the heart. *J. Clin. Invest.*, 96: 693-9 (1995).
Nagaraja et. al., X chromosome map at 75-kb STS resolution, revealing extremes of recombination and GC content. *Genome Res.*, 7: 210-22 (1997).
Nakase et. al., Transient and localized expression of bone morphogenetic protein 4 messenger RNA during fracture healing. *J. Bone Miner. Res.*, 9(5):651-9 (1994).
Nelson, Positional cloning reaches maturity. *Curr. Opin. Genet. Devel.*, 5:298-303 (1995).
Nickel et. al., The crystal structure of the BMP-2: BMPR-1A complex and the generation of BMP-2 antagonists. *J. Bone Joint Surg.*, 83-A:S1-7-S1-14 (2001).
Nicolas et. al., An age-related decrease in the concentration of insulin-like growth factor binding protein-5 in human cortical bone. *Calcif. Tissue Int.*, 57:206-12 (1995).
Nifuji et. al., Coordinated expression of noggin and bone morphogenetic proteins (BMPs) during early skeletogenesi and induction of noggin expression by BMP-7. *J. Bone Miner. Res.*, 14(12):2057-66 (1999).
Nisonoff et. al., Separation of univalent fragments from the bivalent rabbit antidody molecule by reduction of disulfide bonds. *Arch. Biochem. Biophys.*, 89:230-44 (1960).
Niu et. al., Sclerostin inhibition leads to increased periosteal and endocortical bone formation as well as decreased cortical porosity in aged ovariectomized rats. *J. Bone Min. Res.*, 22(Suppl. S1) S65 (2007).
Nordsletten et. al., The neuronal regulation of fracture healing. *Acta Orthop Scand.*, 65(3): 299-304 (1994).
Notice of Opposition against European Patent No. 1133558, Opponent: Eli Lilly and Company, dated May 31, 2007.
Notice of Opposition against European Patent No. 1721979, Opponent: Eli Lilly & Company, dated Jun. 15, 2011.
Notice of Opposition against European Patent No. 1721979, Opponent: Laudens, dated Jun. 15, 2011.
Notice of Opposition against European Patent No. 1721979, Opponent: Novartis AG, dated Jun. 15, 2011.
Notice of Opposition to European Patent No. 1 133 558, dated May 29, 2007.
Nygren et. al., Scaffolds for engineering novel binding sites in proteins. *Curr. Opin. Struct. Biol.*, 7:463-9 (1997).
Observations of Opponent: Laudens in response to summons to oral proceedings in Opposition against European Patent No. 1721979, dated Feb. 25, 2013.
Oelgeschlager et. al., The evolutionarily conserved BMP-binding protein twisted gastrulation promotes BMP signalling. *Nature*, 405:757-63 (2000).

(56) References Cited

OTHER PUBLICATIONS

OMIM #607625, Niemann-pick disease, type C2 (2007).
Ominsky, et. al., Sclerostin monoclonal antibody treatment increases bone strength in aged osteopenic ovariectomozed rats. *J. Bone Min. Res.*, 21(1): S44 PRES1161 (2006). Abstract.
Opposition Decision for Opposition against European Patent No. 1721979, dated Aug. 2, 2013.
Opposition Statement of May 20, 2007 filed by Opponent 2 (Eli Lilly) against European Patent No. 1133558.
Oreffo et. al., Human bone marrow osteoprogenitors express estrogen receptor-alpha and bone morphogenetic proteins 2 and 4 mRNA during osteoblastic differentiation. *J. Cell. Biochem.*, 75:382-92 (1999).
Orriss et al., Purinergic signaling and bone remodeling. *Curr. Opin. Pharmacol.*, 10:322-30 (2010).
Oshima et. al., TGF-β receeptor type II deficiency results in defects of yolk Sac hematopoiesis and vasculogenesis. *Dev. Biol.*, 179:297-302 (1996).
Padhi et. al., Anti-sclerostin antibody increases markers of bone formation in healthy postmenopausal women. *J. Bone Min. Res.*, 22: S37 (2007).
Padhi et. al., OC35—Effects of anti-sclerostin monoclonal antibody in healthy postmenopausal women. *Osteoporosis Int.*, 19: Suppl. 1: S19 (2008).
Padlan et. al., Structure of an antibody-antigen complex; Crystal structure of the HyHEL-10 Feb-lysozyme complex. *Proc. Natl. Acad. Sci. USA*, 86:5938-42 (1989).
Palokangas et. al., Endocytic pathway from the basal plasma membrane to the ruffled border membrane in bone-resorbing osteoclasts. *J. Cell Sci.*, 110: 1767-80 (1997).
Pandey et. al., Nucleotide sequence database: A gold mine for biologists. *TIBS.*, 24: 276-80 (1999).
Papapoulos et. al., Targeting sclerostin as potential treatment of osteoporosis. *Ann. Rheum. Dis.*, 70(Suppl. 1): 1119-22 (2011).
Patel et. al., Current and potential future drug treatments for osteoporosis. *Ann. Rheumatic Dis.*, 55: 700-14 (1996).
Patten et. al., Applications of DNA shuffling to pharmaceuticals and vaccines. *Curr. Opin. Biotechnol.*, 8:724-33 (1997).
Pearson et. al., Effective protein sequence comparison. Chapter 15, pp. 227-258 (1996).
Piao et. al., The proximal promotor region of the gene encoding human 17β-hydroxysteroid dehydrogenase type 1 contains GATA, AP-2, and Sp1 response elements: Analysis of promotor function in choriocarcinoma cells. *Endrocrinol.*, 138(8): 3417-25 (1997).
Piccolo et. al., The head inducer Cerberus is a multifunctional antagonist of nodal, BMP and Wnt signals. *Nature*, 397: 707-10 (1999).
Piek et. al., Specificity, diversity, and regulation of TGF-β superfamily signaling. *Faseb J.*, 13:2105-24 (1999).
Pietromonaco et. al., Protein kinase C-⊖phosphorylation of moesin in the actin-binding sequence. *J. Biol. Chem.*, 273:7594-603 (1998).
Pignatti et. al., Tracking disease genes by reverse genetics. *J. Psychiar. Res.*, 26(4):287-98 (1992).
Pittenger et. al., Multilineage potential of adult human mesenchymal stem cells. *Science*, 284:143-7 (1999).
Pluckthun et. al., Expression of functional anitbody Fv and Fab fragments in *Escherichia coli*. *Meth. Enzymol.*, 178:497-515 (1989).
Pockwinse et. al., Expression of cell growth and bone specific genes at single cell resolution during development of bone tissue-like organization in primary osteoblast cultures. *J. Cell. Biol.*, 49:310-23 (1992).
Poole et. al., Sclerostin is a delayed secreted product of osteocytes that inhibit bone formation. *Feseb J.*, 19: 1842-4 (2005).
Porter, The hydrolysis of rabbit γ-globulin and antibodies with crystalline papain. *Biochem. J.*, 73:119-26 (1959).
Proprietor's Response to Opponent's Statement of Grounds of Appeal, European Patent No. 1133558, dated Apr. 15, 2010.
Proprietor's Response to Oppositions against European Patent No. 1721979, UCB Pharma S.A., dated Feb. 20, 2012.
Proprietor's Written submission in preparation for oral proceedings in Opposition against European Patent No. 1721979, Proprietor: UCB Pharma S.A., dated Feb. 25, 2013.
Quintanar-Guerrero et. al., Preparation techniques and mechanisms of formation of biodegradable nanoparticles from preformed polymers. *Drug Dev. Ind. Pharm.*, 24(12):1113-28 (1998).
Rachner et. al., Osteoporosis: Now and the future. *Lancet*, 377(9773): 1276-87 (2011).
Rawadi et. al., BMP-2 controls alkaline phosphatase expression and osteoblast mineralization by a Wnt autocrine loop. *J. Bone Min. Res.*, 18: 1842-53 (2003).
Reb, Antikorpergegen sclerostin, *Medical Tribune*, 39:12 (2007).
Reddi et. al., The *Escherichia coli* chaperonin 60 (groEL) is a potent stimulator of osteoclast formation. *J. Bone Miner. Res.*, 13(8): 1260-6 (1998).
Reddi, Interplay between bone morphogenetic proteins and cognate binding proteins in bone and cartilage development: Noggin, chordin and DAN. *Arthritis Res.*, 3(1):1-5 (2000).
Response to Proprietor's brief of Apr. 15, 2010, European Patent Opposition, EP-1133558 B1, dated Mar. 18, 2011.
Riggs, Overview of osteoporosis. *West J. Med.*, 154:63-77 (1991).
RnD Systems catalogue excerpt, cited in Opposition against European Patent No. 1721979 by Opponent: Novartis AG dated Jun. 15, 2011.
Roberts et. al., Essential functional interactions of SAFA, a Saccharomyces cerevisiae complex of Spt, Ada, and Gcn5 proteins, with the Snf/Swi and Srb/Mediator complexes. *Genetics*, 147: 451-65 (1997).
Robinson et. al., The sclerostin antibody project. *Hum. Antibodies*, 16: 36 (2007).
Roitt et la., Roitt's Essential Immunology, 9th Edition, pp. 90-91 (1997).
Rosenzweig et. al., Cloning and characterization of a human type II receptor for bone morphogenetic proteins. *Proc. Natl. Acad. Sci. USA*, 92:7632-7636 (1995).
Rosenzweig et. al., GenBank Sequence Database Accession No. CAA88759, Oct. 7, 2008.
Rosenzweig et. al., GenBank Sequence Database Accession No. Z48923, Oct. 7, 2008.
Rudikoff, et. al., Single amino acid substitution altering antigen-binding specificity. *Proc. Natl. Acad. Sci. USA*, 79:1979-83 (1982).
Ruppert et. al., Human bone morphogenetic protein 2 contains a heparin-binding site which modifies its biological activity. *Eur. J. Biochem.*, 237: 295-302 (1996).
Sada et. al., Adsorption equilibirum in immuno-affinity chromatography with polyclonal and monoclonal antibodies. *Biotechnol. Bioengin.*, 28 (1986). Abstract.
Sali et. al., Comparative protein modeling by satisfaction of spatial restraints. *J. Mol. Biol.*, 234(3):779-815 (1993).
Sambrook et. al., Synthetic oligonucleotide probes, molecular cloning—A Laboratory Manual, Ch.11:11.1-11.19 and 11.58-11.61 (1989).
Sanger et. al., DNA sequencing with chain-terminating inhibitors. *Proc. Natl. Acad. Sci. USA*, 74:5463-7 (1997).
Sastry et. al., Cloning of the immunological repertoire in *Escherichia coli* for generation of monoclonal catalytic antibodies: Construction of a heavy chain variable region-specific cDNA library. *Proc. Natl. Acad. Sci. USA*, 86:5728-32 (1989).
Scatchard et. al., The attractions of proteins for small molecules and ions. *Ann. N.Y. Acad. Sci.*, 51:660-72 (1949).
Scheufler et. al., Crystal structure of human bone morphogenetic protein-2 at 2.7 A resolution. *J. Mol. Biol.*, 287(1):101-15 (1999).
Schlebusch et. al., Production of a single-chain fragment of the murine anti-idiotypic antibody ACA125 as phage-displayed and soluble antibody by recombinant phage antibody technique. *Hybridoma*, 16:47-52 (1997).
Schlunegger et. al., Refined crystal structure of human transforming growth factor β2 at 1.95 A Resolution. *J. Mol. Biol.*, 231(2):445-458 (1993).
Schmidt et. al., Retrovirus-induced osteopetrosis in mice: Effects of viral infection on osteogenic differentiation in skeletoblast cell cultures. *Am. J. Pathol.*, 129(3): 503-10 (1987).

(56) References Cited

OTHER PUBLICATIONS

Schmitt et. al., Bone morphogenetic proteins: An update on basic biology and clinical relevance. *J. Orth. Res.*, 17:269-78 (1999).
Schwappacher et. al., NCBI Sequence Database Accession No. NM_001204, Aug. 16, 2009.
Scully et. al., BRCA1 is a component of the RNA polymerase II holoenzyme. *Proc. Natl. Acad. Sci. USA*, 94: 5605-10 (1997).
Second declaration of Martyn Robinson, citation in Appeal, European Patent No. 1133558, dated Apr. 15, 2010.
Serra et. al., Expression of a truncated, kinase-defective TGF-β type II receoptor in mouse skeletal tissue promotes terminal chondrocyte differentiation and osteoarthritis. *J. Cell. Biol*, 139(2):541-52 (1997).
Sigmund, Viewpoint: Are studies in genetically altered mice out of control? *Arterioscler. Thromb. Vasc. Biol.*, 20:1425-9 (2000).
Silverman et. al., Sclerostin, *J. Osteoporosis*, 2010: 1-3 (2010).
Sippl et. al., Threading thrills and threats. *Structure*, 4(1):15-19 (1996).
Siris, Clinical Review: Paget's disease of bone. *J. Bone Miner. Res.*, 13(7): 1061-5 (1998).
Sivakumar et. al., New insights into extracellular matrix assembly and reorganization from dynamic imaging of extracellular matrix proteins in living osteoblasts. *J. Cell. Sci.*, 119(7):1350-60 (2006).
Skiple Skjerpen et. al., Binding of FGF-1 variants to protein kinase CK2 correlates with mitogenicity. *EMBO J.*, 21(15): 4058-69 (2002).
Slater et. al., Involvement of platelets in stimulating osteogenic activity. *J. Orthopaedic Res.*, 13: 655-63 (1995).
Smith et. al., Glucocorticoids inhibit development stage-specific osteoblast cell cycle. *J. Biol. Chem.*, 275:19992-20001 (2000).
Smith, TGF β inhibitors, new and unexpected requirements in vertebrate development. *TIG*, 15(1):3-5 (1999).
Sohocki et. al., A range of clinical phenotypes associated with mutations in CRX, a photoreceptor transcription-factor gene. *Am. J. Hum. Genet.*, 63: 1307-15 (1998).
Spranger, International classification of osteochondrodysplasias, *Eur. J. Pediatr.*, 151: 407-15 (1992).
Staehling-Hampton et. al., A 52-kb delection in the SOST-MEOX1 intergenic region on 17q12-q21 is associated with van Buchem disease in the Dutch population. *Am. J. Med. Gen.*, 110: 144-52 (2002).
Stanley et. al., DAN is a secreted glycopeotein related to Xenopus cerberus. Mech. Dev., 77: 173-84 (1998).
Statement of Grounds of Appeal to Decision of Opposition against European Patent No. 1133558, dated Sep. 28, 2009.
Stenmark et. al., Distinct structural elements of rab5 define its functional specificity. *Embo J.*, 13(3): 575-83 (1994).
Strachan et. al. (Eds.), Diagram from text book entitled Human Molecular Genetics, 2nd Edition (1999).
Strachan et. al. (Eds.), Human Molecular Genetics, 1st Edition, p. 420 (1996).
Strachan et. al., (Eds.), Human Molecular Genetics, 2nd Edition, Figure 15.4 (1999).
Submission in response to oral proceedings in Opposition against European Patent No. 1721979, Opponent: Eli Lilly, dated Apr. 24, 2013.
Sudo et. al., In vitro differentiation and calcification in a new clonal osteogenic cell line derived from newborn mouse calvaria. *J. Cell Biol.*, 96:191-8 (1983).
Summons to attend oral proceedings for Opposition against European Patent No. 1133558, dated Nov. 4, 2008.
Summons to attend oral proceedings in Opposition against European Patent No. 1721979, dated Nov. 12, 2012.
Sutherland et. al., Sclerostin romotes the apoptosis of human osteoblastic cells: A novel regulation of bone formation. *Bone*, 35:828-35 (2004).
Suzawa et. al., Extracellular matrix-associated bone morphogenetic proteins are essential for differentiation of murine osteoblastic cells in vitro. *Endocrinology*, 140:2125-33 (1999).

Sverdlov et. al., Perpetually mobile footprints of ancient infections in human genome. *FEBS Lett.*, 428: 1-6 (1998).
Sylatron label, cited in Opposition against European Patent No. 1721979 by Opponent: Novartis AG, dated Jun. 15, 2011.
Takakura, Drug delivery systems in gene therapy. *Nippon Rinsho*, 56(3):691-5 (1998) (Abstract Only).
Takeda et. al., GenBank Sequence Database Accession No. AAB33865, May 27, 1995.
Takeda et. al., GenBank Sequence Database Accession No. D38082, dated Dec. 27, 2006.
Takeda et. al., GenBank Sequence Database Accession No. S75359, May 27, 1995.
Takeda et. al., NCBI Sequence Database Accession No. NM_030849, Feb. 11, 2009.
Takeda, Expression of serine/threonine kinase receptors during ectopic bone formation induced by bone morphogenetic protein (BMP). *Kokubyo Gakkai Zasshi*, 61(4):512-26 (1994).
Tam et. al., TGF-β receptor expression on human keratinocytes: A 150 kDa GPI-anchored TGF-β1 binding protein forms a heteromeric complex with type I and type II receptors. *J. Cellular Biochem.*, 70:573-56 (1998).
Taylor et. al., Human immunoglobulin transgenes undergo rearrangement, somatic mutation and class switching in mice that lack endogenous IgM. *Int. Immun.*, 6:579 (1994).
The Merck Manual—Second Home Edition, Ch. 61:1-3 (2005).
Thompson et. al., Affinity maturation of a high-affinity human monoclonal antibody against the third hypervariable loop of human immunodeficiency virus: Use of phage display to improve affinity and broaden strain reactivity. *J. Mol. Biol.*, 256:7-88 (1996).
Thornton et. al., Prediction of progress at last. *Nature*, 354:105-6 (1991).
Tjaderhane et. al., A high sucrose diet decreases the mechanical strength of bones in growing rats. *J. Nutr.*, 128: 1807-10 (1998).
Tuncay et. al., Oxygen tension regulates osteoblast function. *Am. J. Orthod. Dentofac. Orthop.*, 105: 457-63 (1994).
UCB and Amgen announce positive phase 2 results of CDP7851/AMG785 in patients with post menopausal osteoporosis (PMO), dated Apr. 21, 2011—Citation in Opposition against European Patent No. 1721979.
Uitterlinden et. al., Relation of alleles of the collagen type Iα1 gene to bone density and the risk of osteoporotic fractures in postmenopausal women. *New Engl. J. Med.*, 338: 1016-21 (1998).
Utting et al., Hypoxia stimulates osteoclast formation from human peripheral blood. Cell Biochem. Funct., 28:374-80 (2010).
Valero et. al., Quaternary structure of casein kinase 2. *J. Biol. Chem.*, 27(14): 8345-52 (1995).
van Bezooijen et. al., Sclerostin is an osteocyte-expressed negative regulator of bone formation, but not a classical BMP antagonist. *J. Exp. Med.*, 199: 805-14 (2004).
van Bezooijen et. al., SOST/sclerostin, an osteocyte-derived negative regulator of bone formation, *Cytokine Growth Factor Rev.*, 16: 319-27 (2005).
van Bezooijen et. al., Wnt but not BMP signaling is involved in the inhibitory action of sclerostin on BMP-stimulated bone formation. *J. Bone. Miner. Res.*, 22:19-28 (2007).
Van Hul et. al., Van Buchem Disease (hyperostosis corticalis generalisata) maps to chromosome 17q12-a21. *Am. J. Hum. Genet.*, 2:391-9 (1998).
Vanier et. al., Recent advances in elucidating Niemann-Pick C disease. Brain Pathol., 8: 163- 74 (1998).
Veverka et. al., Characterization of the structural features and interactions of sclerostin. *J. Biol. Chem.*, 284(16): 10890-900 (2009).
Viter et. al., Analysis of antigenic structure of potato virus M Ukrainian strains. *Biopolimery I Kletka, Naukova Dumka, Kiev K, UK*, 16: 312-9 (2000).
Von Bubnoff et. al., Intracellular BMP signaling regulation in vertebrates: Pathway or network? *Dev. Biol.*, 239:1-14 (2001).
Wall, Transgenic livestock: Progress and prospects for the future. *Theriogenology*, 45:57-68 (1996).
Wang et. al., IFP 35 forms complexes with B-ATF, a member of the AP1 family of transcription factors. Biochem. Biophys. *Res. Commun.*, 229: 316-22 (1996).

(56) References Cited

OTHER PUBLICATIONS

Wang, Bone morphogenetic proteins (BMPs): Therapeutic potential in healing bony defects. *TIBTECH*, 11:379-83 (1993).
Warmington et. al., Sclerostin antagonism in adult rodents, via monoclonal antibody mediated blockade, increases bone mineral density and implicates sclerostia as a key regulator of bone mass during adulthood. *J. Bone Min. Res.*, 19:S56-7 (2004).
Warmington et. al., Sclerostin monoclonal antibody treatment of osteoporotic rats completely reverses one year of overiectomy-induced systemic bone loss, *J. Bone Min. Res.*, 20:S22 (2005).
Winkler et. al., Noggin and sclerostin bone morphogenetic protein antagonists form a mutually inhibitory complex. *J. Biol. Chem.*, 279(35): 36296-8 (2004).
Winkler et. al., Osteocyte control of bone formation via sclerostin, a novel BMP antagonist. *EMBO J.* 22: 6267-76 (2003).
Winkler et. al., Sclerostin inhibition of Wnt-3a-induced C3H10T1/2 cell differentiation is indirect and mediated by bone morphogenetic proteins. *J. Biol. Chem.* 280: 2498-502 (2005).
Winter et. al., Making antibodies by phase display technology. *Annu. Rev. Immunol.*, 12:433-55 (1994).
Wolff et. al., Monoclonal antibody homodimers: Enhanced antitumor activity in nude mice. Cancer Res., 53:2560-5 (1993).
Wollenberger et. al. (Eds.), Analytische Biochemie, Chapter 3, pp. 47-49 (2003).
World Health Organization Scientific Group on the Prevention and Management of Osteoporosis, "Prevention and management of osteoporosis: report of a WHO scientific group." WHO Technical Report Series, 921 (2000).
Written submission—Observation by a Third Party According to Art. 115 EPC, Opposition to European Patent No. 1133558, dated Nov. 25, 2008.
Written submission in response to summons to oral proceedings in Opposition against European Patent No. 1721979, Opponent: Norvartis AG, dated Feb. 25, 2013.
Written submission in response to summons to oral proceedings in Opposition against European Patent No. 1721979, Opponent: Eli Lilly Company, dated Feb. 25, 2013.
Written submission of Eli Lilly & Company to European Patent Office, Opposition to European Patent No. 1133558, dated May 29, 2007.
Written Submission of Eli Lilly & Company, Opposition to European Patent No. 1133558, dated Mar. 9, 2009.
Written submission of UCB S.A., Proprietor's Preliminary Response to the Opponent's submission of Mar. 9, 2009, Opposition to European Patent No. 1133558, dated Mar. 20, 2009.
Written submission of UCB S.A., Proprietor's Response to Opposition against European Patent No. 1133558, dated Mar. 14, 2008.
Yanagita et. al., USAG-1: A bone morphogenetic protein antagonist abundantly expressed in the kidney. *Biochem. Biophys. Res. Comm.*,316: 490-550 (2004).
Yang et. al., CDR walking mutagenesis for the affinity maturation of a potent human Anti-HIV-1 antibody into the picomolar range. *J. Mol. Biol.*, 254:392-403 (1995).
Yates et. al., Inhibition of bone resorption by inorganic phosphate in mediated by both reduced osteoclast formation and decreased activity of mature osteoclasts. *J. Bone Miner. Res.*, 6(5): 476-8 (1990).
Yerges et. al., NCBI Sequence Database Accession No. NM_001203, Jul. 12, 2009.
Yerges et. al., NCBI Sequence Database Accession No. NP_001194, Jul. 12, 2009.
Yoshida et. al., Osteoinduction capability of recombinant human bone morphogenetic protein-2 in intramuscular and subcutaneous sites: An experimental study. *J. Cranio-Maxillofac. Surg.*, 26: 112-5 (1998).
Zambaux et. al., Influence of experimental parameters on the characteristics of poly(lactic acid) nanoparticles prepared by a double emulsion method. *J. Controlled Rel.*, 50(1-3):31-40 (1998).
Zhang et. al., Humanization of an anti-human TNF-β antibody by variable region resurfacing with the aid of molecular modeling. *Molec. Immunol.*, 42(12):1445-51 (2005).
Zimmerman et. al., The spemann organizer signal noggin binds and inactives bone morphogenetic protein 4. *Cell*, 86(4):599-606 (1996).
Zlotogora et. al., Dominance and homozygosity, *Am. J. Med. Genet.*, 68: 412-6 (1997).
zur Muhlen et. al., Solid lipid nanoparticles (SLN) for controlled drug delivery—Drug release and release mechanism. *Eur. J. Pharm. Biopharm.*, 45(2):149-55 (1998).
Getts, Have we overestimated the benefit of human(ized) antibodies?, *mAbs*, 2(6):682-94 (2010).
Harding et al., The immunogenicity of humanized and fully human antibodies: Residual immunogenicity resides in the CDR regions, *mAbs*, 2(3):256-65 (2010).
Ominsky et al., Two doses of sclerostin antibody in cynomolgus monkeys increases bone formation, bone mineral density, and bone strength, *J. Bone Min. Res.*, 25(5):948-59 (2010).
Padhi et al., Single-dose placebo-controlled, randomized study of AMG 785, a sclerostin monoclonal antibody, *J. Bone. Min. Res.*, 26(1):19-26 (2011).
Ritter et al., Serological analysis of human anti-human antibody responses in colon cancer patients treated with repeated doses of humanized monoclonal antibody A33, *Can. Res.*, 61:6851-9 (2001).
Wijenayaka et al., Sclerostin stimulates osteocyte support of osteoclast activity by a RANKL-dependent pathway, *PLoS One*, 6(10):e25900 (2011).
International Search Report and Written Opinion of the European Patent Office, PCT/EP2013/064052, dated Oct. 23, 2013.
Bone et al., Effects of denosumab on bone mineral density and bone turnover in postmenopausal women. *J. Clin. Endocrinol. Metab.*93: 2149-57 (2008).
Ke et al., Sclerostin and Dickkopf-1 as therapeutic targets in bone disease. *Endocrine Rev.*33(5): 747-83 (2012).

\* cited by examiner

FIGURE 7

| Sequence Description | Sequence |
|---|---|
| Ab-A and Ab-1 CDR-L1 | QSSQSVYDNNWLA (SEQ ID NO: 54) |
| Ab-A and Ab-1 CDR-L2 | DASDLAS (SEQ ID NO: 55) |
| Ab-A and Ab-1 CDR-L3 | QGAYNDVIYA (SEQ ID NO: 56) |
| Ab-A and Ab-1 CDR-H1 | SYWMN (SEQ ID NO: 51) |
| Ab-A and Ab-1 CDR-H2 | TIDSGGRTDYASWAKG (SEQ ID NO: 52) |
| Ab-A and Ab-1 CDR-H3 | NWNL (SEQ ID NO: 53) |
| Ab-A light chain | SEQ ID NO: 23 |
| Ab-A heavy chain | SEQ ID NO: 27 |
| Ab-1 light variable region (with signal sequence) | SEQ ID NO: 75 |
| Ab-1 heavy variable region (with signal sequence) | SEQ ID NO: 77 |
| Ab-B CDR-L1 | SASSSVSFVD (SEQ ID NO: 60) |
| Ab-B CDR-L2 | RTSNLGF (SEQ ID NO: 61) |
| Ab-B CDR-L3 | QQRSTYPPT (SEQ ID NO: 62) |
| Ab-B CDR-H1 | TSGMGVG (SEQ ID NO: 57) |
| Ab-B CDR-H2 | HIWWDDVKRYNPVLKS (SEQ ID NO: 58) |
| Ab-B CDR-H3 | EDFDYDEEYYAMDY (SEQ ID NO: 59) |
| Ab-B light chain | SEQ ID NO: 31 |
| Ab-B heavy chain | SEQ ID NO: 35 |
| Ab-C CDR-L1 | KASQSVDYDGDSYMN (SEQ ID NO: 48) |
| Ab-C CDR-L2 | AASNLES (SEQ ID NO: 49) |
| Ab-C CDR-L3 | QQSNEDPWT (SEQ ID NO: 50) |
| Ab-C CDR-H1 | DCYMN (SEQ ID NO: 45) |
| Ab-C CDR-H2 | DINPFNGGTTYNQKFKG (SEQ ID NO: 46) |
| Ab-C CDR-H3 | SHYYFDGRVPWDAMDY (SEQ ID NO: 47) |
| Ab-C light chain | SEQ ID NO: 15 |
| Ab-C heavy chain | SEQ ID NO: 19 |
| Ab-D CDR-L1 | QASQGTSINLN (SEQ ID NO: 42) |
| Ab-D CDR-L2 | GSSNLED (SEQ ID NO: 43) |
| Ab-D CDR-L3 | LQHSYLPYT (SEQ ID NO: 44) |
| Ab-D CDR-H1 | DHYMS (SEQ ID NO: 39) |
| Ab-D CDR-H2 | DINPYSGETTYNQKFKG (SEQ ID NO: 40) |
| Ab-D CDR-H3 | DDYDASPFAY (SEQ ID NO: 41) |
| Ab-D light chain | SEQ ID NO: 7 |
| Ab-D heavy chain | SEQ ID NO: 11 |
| Ab-2 CDR-L1 | RASSSVYYYMH (SEQ ID NO: 275) |
| Ab-2 CDR-L2 | ATSNLAS (SEQ ID NO: 276) |
| Ab-2 CDR-L3 | QQWSSDPLT (SEQ ID NO: 277) |
| Ab-2 CDR-H1 | DYFIH (SEQ ID NO: 287) |
| Ab-2 CDR-H2 | RLDPEDGESDYAPKFQD (SEQ ID NO: 288) |
| Ab-2 CDR-H3 | EDYDGTYTFFPY (SEQ ID NO: 289) |
| Ab-2 light chain | SEQ ID NO: 117 |
| Ab-2 heavy chain | SEQ ID NO: 121 |
| Ab-3 and Ab-15 CDR-L1 | SVSSTISSNHLH (SEQ ID NO: 278) |

FIGURE 7 (cont.)

| Sequence Description | Sequence |
|---|---|
| Ab-3 and Ab-15 CDR-L2 | GTSNLAS (SEQ ID NO: 279) |
| Ab-3 and Ab-15 CDR-L3 | QQWSSYPLT (SEQ ID NO: 280) |
| Ab-3 and Ab-15 CDR-H1 | DFYLH (SEQ ID NO: 290) |
| Ab-3 and Ab-15 CDR-H2 | RIDPENGDTLYDPKFQD (SEQ ID NO: 291) |
| Ab-3 and Ab-15 CDR-H3 | EADYFHDGTSYWYFDV (SEQ ID NO: 292) |
| Ab-3 light chain | SEQ ID NO: 125 |
| Ab-3 heavy chain | SEQ ID NO: 129 |
| Ab-15 light variable region | SEQ ID NO: 384 |
| Ab-15 heavy variable region | SEQ ID NO: 386 |
| Ab-15 light chain | SEQ ID NO: 221 |
| AB-15 heavy chain | SEQ ID NO: 225 |
| Ab-4 and Ab-5 CDR-L1 | RASQDISNYLN (SEQ ID NO: 78) |
| Ab-4 and Ab-5 CDR-L2 | YTSRLLS (SEQ ID NO: 79) |
| Ab-4 and Ab-5 CDR-L3 | QQGDTLPYT (SEQ ID NO: 80) |
| Ab-4 and Ab-5 CDR-H1 | DYNMH (SEQ ID NO: 245) |
| Ab-4 and Ab-5 CDR-H2 | EINPNSGGAGYNQKFKG (SEQ ID NO: 246) |
| Ab-4 and Ab-5 CDR-H3 | LGYDDIYDDWYFDV (SEQ ID NO: 247) |
| Ab-4 light chain | SEQ ID NO: 133 |
| Ab-4 heavy chain | SEQ ID NO: 137 |
| Ab-5 light variable region | SEQ ID NO: 376 |
| Ab-5 heavy variable region | SEQ ID NO: 378 |
| Ab-5 light chain | SEQ ID NO: 141 |
| Ab-5 heavy chain | SEQ ID NO: 145 |
| Ab-6 CDR-L1 | RASQDISNYLN (SEQ ID NO: 81) |
| Ab-6 CDR-L2 | YTSRLHS (SEQ ID NO: 99) |
| Ab-6 CDR-L3 | QQGDTLPYT (SEQ ID NO: 100) |
| Ab-6 CDR-H1 | DYNMH (SEQ ID NO: 248) |
| Ab-6 CDR-H2 | EINPNSGGSGYNQKFKG (SEQ ID NO: 249) |
| Ab-6 CDR-H3 | LVYDGSYEDWYFDV (SEQ ID NO: 250) |
| Ab-6 light chain | SEQ ID NO: 149 |
| Ab-6 heavy chain | SEQ ID NO: 153 |
| Ab-7 CDR-L1 | RASQVITNYLY (SEQ ID NO: 101) |
| Ab-7 CDR-L2 | YTSRLHS (SEQ ID NO: 102) |
| Ab-7 CDR-L3 | QQGDTLPYT (SEQ ID NO: 103) |
| Ab-7 CDR-H1 | DYNMH (SEQ ID NO: 251) |
| Ab-7 CDR-H2 | EINPNSGGAGYNQQFKG (SEQ ID NO: 252) |
| Ab-7 CDR-H3 | LGYVGNYEDWYFDV (SEQ ID NO: 253) |
| Ab-7 light chain | SEQ ID NO: 157 |
| Ab-7 heavy chain | SEQ ID NO: 161 |
| Ab-8 CDR-L1 | RASQDISNYLN (SEQ ID NO: 104) |
| Ab-8 CDR-L2 | YTSRLLS (SEQ ID NO: 105) |
| Ab-8 CDR-L3 | QQGDTLPYT (SEQ ID NO: 106) |
| Ab-8 CDR-H1 | DYNMH (SEQ ID NO: 254) |
| Ab-8 CDR-H2 | EINPNSGGAGYNQKFKG (SEQ ID NO: 255) |
| Ab-8 CDR-H3 | LGYDDIYDDWYFDV (SEQ ID NO: 256) |

FIGURE 7 (cont.)

| Sequence Description | Sequence |
|---|---|
| Ab-8 light chain | SEQ ID NO: 165 |
| Ab-8 heavy chain | SEQ ID NO: 169 |
| Ab-9 CDR-L1 | RASQDISNYLN (SEQ ID NO: 107) |
| Ab-9 CDR-L2 | YTSRLFS (SEQ ID NO: 108) |
| Ab-9 CDR-L3 | QQGDTLPYT (SEQ ID NO: 109) |
| Ab-9 CDR-H1 | DYNMH (SEQ ID NO: 257) |
| Ab-9 CDR-H2 | EINPNSGGAGYNQKFKG (SEQ ID NO: 258) |
| Ab-9 CDR-H3 | LGYDDIYDDWYFDV (SEQ ID NO: 259) |
| Ab-9 light chain | SEQ ID NO: 173 |
| Ab-9 heavy chain | SEQ ID NO: 177 |
| Ab-10 CDR-L1 | RASQDISNYLN (SEQ ID NO: 110) |
| Ab-10 CDR-L2 | YTSRLLS (SEQ ID NO: 111) |
| Ab-10 CDR-L3 | QQGDTLPYT (SEQ ID NO: 112) |
| Ab-10 CDR-H1 | DYNMH (SEQ ID NO: 260) |
| Ab-10 CDR-H2 | EINPNSGGAGYNQKFKG (SEQ ID NO: 261) |
| Ab-10 CDR-H3 | LGYDDIYDDWYFDV (SEQ ID NO: 262) |
| Ab-10 light chain | SEQ ID NO: 181 |
| Ab-10 heavy chain | SEQ ID NO: 185 |
| Ab-11 and Ab-16 CDR-L1 | RASSSISYIH (SEQ ID NO: 281) |
| Ab-11 and Ab-16 CDR-L2 | ATSNLAS (SEQ ID NO: 282) |
| Ab-11 and Ab-16 CDR-L3 | QQWSSDPLT (SEQ ID NO: 283) |
| Ab-11 and Ab-16 CDR-H1 | DYYIH (SEQ ID NO: 293) |
| Ab-11 and Ab-16 CDR-H2 | RVDPDNGETEFAPKFPG (SEQ ID NO: 294) |
| Ab-11 and Ab-16 CDR-H3 | EDYDGTYTWFPY (SEQ ID NO: 295) |
| Ab-11 light chain | SEQ ID NO: 189 |
| Ab-11 heavy chain | SEQ ID NO: 193 |
| Ab-16 light variable region | SEQ ID NO: 388 |
| Ab-16 heavy variable region | SEQ ID NO: 390 |
| Ab-16 light chain | SEQ ID NO: 229 |
| Ab-16 heavy chain | SEQ ID NO: 233 |
| Ab-12 CDR-L1 | RASQDISNYLN (SEQ ID NO: 113) |
| Ab-12 CDR-L2 | YTSTLQS (SEQ ID NO: 114) |
| Ab-12 CDR-L3 | QQGDTLPYT (SEQ ID NO: 115) |
| Ab-12 CDR-H1 | DYNMH (SEQ ID NO: 263) |
| Ab-12 CDR-H2 | EINPNSGGSGYNQKFKG (SEQ ID NO: 264) |
| Ab-12 CDR-H3 | LGYYGNYEDWYFDV (SEQ ID NO: 265) |
| Ab-12 light chain | SEQ ID NO: 197 |
| Ab-12 heavy chain | SEQ ID NO: 201 |
| Ab-13 and Ab-14 CDR-L1 | RASSSVTSSYLN (SEQ ID NO: 284) |
| Ab-13 and Ab-14 CDR-L2 | STSNLAS (SEQ ID NO: 285) |
| Ab-13 and Ab-14 CDR-L3 | QQYDFFPST (SEQ ID NO: 286) |
| Ab-13 and Ab-14 CDR-H1 | DYYMN (SEQ ID NO: 296) |
| Ab-13 and Ab-14 CDR-H2 | DINPYNDDTTYNHKFKG (SEQ ID NO: 297) |
| Ab-13 and Ab-14 CDR-H3 | ETAVITTNAMD (SEQ ID NO: 298) |
| Ab-13 light chain | SEQ ID NO: 205 |

FIGURE 7 (cont.)

| Sequence Description | Sequence |
|---|---|
| Ab-13 heavy chain | SEQ ID NO: 209 |
| Ab-14 light variable region | SEQ ID NO: 380 |
| Ab-14 heavy variable region | SEQ ID NO: 382 |
| Ab-14 light chain | SEQ ID NO: 213 |
| Ab-14 heavy chain | SEQ ID NO: 217 |
| Ab-17 and Ab-18 CDR-L1 | SVSSSISSSNLH (SEQ ID NO: 116) |
| Ab-17 and Ab-18 CDR-L2 | GTSNLAS (SEQ ID NO: 237) |
| Ab-17 and Ab-18 CDR-L3 | QQWTTTYT (SEQ ID NO: 238) |
| Ab-17 and Ab-18 CDR-H1 | DYYIH (SEQ ID NO: 266) |
| Ab-17 and Ab-18 CDR-H2 | RIDPDNGESTYVPKFQG (SEQ ID NO: 267) |
| Ab-17 and Ab-18 CDR-H3 | EGLDYGDYYAVDY (SEQ ID NO: 268) |
| Ab-17 light variable region (with signal sequence) | SEQ ID NO: 299 |
| Ab-17 heavy variable region (with signal sequence) | SEQ ID NO: 301 |
| Ab-18 light variable region (with signal sequence) | SEQ ID NO: 303 |
| Ab-18 heavy variable region (with signal sequence) | SEQ ID NO: 305 |
| Ab-19, Ab-20 and Ab-23 CDR-L1 | RASQDISSYLN (SEQ ID NO: 239) |
| Ab-19, Ab-20 and Ab-23 CDR-L2 | STSRLNS (SEQ ID NO: 240) |
| Ab-19, Ab-20 and Ab-23 CDR-L3 | QQDIKHPT (SEQ ID NO: 241) |
| Ab-19, Ab-20 and Ab-23 CDR-H1 | DYIMH (SEQ ID NO: 269) |
| Ab-19, Ab-20 and Ab-23 CDR-H2 | YINPYNDDTEYNEKFKG (SEQ ID NO: 270) |
| Ab-19, Ab-20 and Ab-23 CDR-H3 | SIYYYDAPFAY (SEQ ID NO: 271) |
| Ab-19 light variable region | SEQ ID NO: 314 |
| Ab-19 heavy variable region | SEQ ID NO: 327 |
| Ab-19 light chain (with signal sequence) | SEQ ID NO: 307 |
| Ab-19 heavy chain (with signal sequence) | SEQ ID NO: 309 |
| Ab-20 light variable region (with signal sequence) | SEQ ID NO: 311 |
| Ab-20 heavy variable region (with signal sequence) | SEQ ID NO: 313 |
| Ab-23 light variable region | SEQ ID NO: 364 |
| Ab-23 heavy variable region | SEQ ID NO: 366 |
| Ab-23 light chain | SEQ ID NO: 341 |
| Ab-23 heavy chain | SEQ ID NO: 345 |
| Ab-21 and Ab-22 CDR-L1 | KASQDVFTAVA (SEQ ID NO: 242) |
| Ab-21 and Ab-22 CDR-L2 | WASTRHT (SEQ ID NO: 243) |
| Ab-21 and Ab-22 CDR-L3 | QQYSSYPLT (SEQ ID NO: 244) |
| Ab-21 and Ab-22 CDR-H1 | DYYMH (SEQ ID NO: 272) |
| Ab-21 and Ab-22 CDR-H2 | RIDPENGDIIYDPKFQG (SEQ ID NO: 273) |
| Ab-21 and Ab-22 CDR-H3 | DAGDPAWFTY (SEQ ID NO: 274) |
| Ab-21 light variable region (with signal sequence) | SEQ ID NO: 315 |
| Ab-21 heavy variable region (with signal | SEQ ID NO: 317 |

FIGURE 7 (cont.)

| Sequence Description | Sequence |
|---|---|
| sequence) | |
| Ab-22 light variable region | SEQ ID NO: 368 |
| Ab-22 heavy variable region | SEQ ID NO: 370 |
| Ab-24 CDR-L1 | KASQSVDYDGTSYMN (SEQ ID NO: 351) |
| Ab-24 CDR-L2 | AASNLES (SEQ ID NO: 352) |
| Ab-24 CDR-L3 | QQSNEDPFT (SEQ ID NO: 353) |
| Ab-24 CDR-H1 | TYWMN (SEQ ID NO: 358) |
| Ab-24 CDR-H2 | MIHPSASEIRLDQKFKD (SEQ ID NO: 359) |
| Ab-24 CDR-H3 | SGEWGSMDY (SEQ ID NO: 360) |
| Ab-24 light chain | SEQ ID NO: 350 |
| Ab-24 heavy chain | SEQ ID NO: 357 |

FIGURE 8

```
                       SEQUENCE LISTING

<110>  Eli Lilly and Company
       Korytko, Andrew I.
       Marquis, David  Matthew
       Smith , Eric  Michael
       Swanson , Barbara  Anne <120>  Anti-Sclerostin Antibodies

<130>  X17563

<150>  US 60/895813
<151>  2007-03-20

<160>  43

<170>  PatentIn version 3.4

<210>  1
<211>  213
<212>  PRT
<213>  Homo sapiens

<400>  1
```

Met Gln Leu Pro Leu Ala Leu Cys Leu Val Cys Leu Leu Val His Thr
1               5                   10                  15

Ala Phe Arg Val Val Glu Gly Gln Gly Trp Gln Ala Phe Lys Asn Asp
            20                  25                  30

Ala Thr Glu Ile Ile Pro Glu Leu Gly Glu Tyr Pro Glu Pro Pro Pro
        35                  40                  45

Glu Leu Glu Asn Asn Lys Thr Met Asn Arg Ala Glu Asn Gly Gly Arg
    50                  55                  60

Pro Pro His His Pro Phe Glu Thr Lys Asp Val Ser Glu Tyr Ser Cys
65                  70                  75                  80

Arg Glu Leu His Phe Thr Arg Tyr Val Thr Asp Gly Pro Cys Arg Ser
                85                  90                  95

Ala Lys Pro Val Thr Glu Leu Val Cys Ser Gly Gln Cys Gly Pro Ala
            100                 105                 110

Arg Leu Leu Pro Asn Ala Ile Gly Arg Gly Lys Trp Trp Arg Pro Ser
        115                 120                 125

Gly Pro Asp Phe Arg Cys Ile Pro Asp Arg Tyr Arg Ala Gln Arg Val
    130                 135                 140

FIGURE 8 Continued...

```
Gln Leu Leu Cys Pro Gly Gly Glu Ala Pro Arg Ala Arg Lys Val Arg
145                 150                 155                 160

Leu Val Ala Ser Cys Lys Cys Lys Arg Leu Thr Arg Phe His Asn Gln
                165                 170                 175

Ser Glu Leu Lys Asp Phe Gly Thr Glu Ala Ala Arg Pro Gln Lys Gly
            180                 185                 190

Arg Lys Pro Arg Pro Arg Ala Arg Ser Ala Lys Ala Asn Gln Ala Glu
        195                 200                 205

Leu Glu Asn Ala Tyr
    210

<210>  2
<211>  444
<212>  PRT
<213>  Artificial

<220>
<223>  Miscellaneous construct

<400>  2

Gln Val Gln Leu Val Gln Ser Gly Ala Glu Val Lys Lys Pro Gly Ser
1               5                   10                  15

Ser Val Lys Val Ser Cys Lys Ala Ser Gly Tyr Thr Phe Thr Asp Tyr
                20                  25                  30

Phe Leu Asn Trp Val Arg Gln Ala Pro Gly Gln Gly Leu Glu Trp Met
            35                  40                  45

Gly Thr Ile Tyr Pro Tyr His Asp Gly Thr Thr Tyr Ser Gln Lys Phe
        50                  55                  60

Lys Gly Arg Val Thr Ile Thr Ala Asp Lys Ser Thr Ser Thr Ala Tyr
65                  70                  75                  80

Met Glu Leu Ser Ser Leu Arg Ser Glu Asp Thr Ala Val Tyr Tyr Cys
                85                  90                  95

Ala Arg Glu Glu Glu Asp Gly Gln Phe Asp Tyr Trp Gly Gln Gly Thr
                100                 105                 110

Thr Val Thr Val Ser Ser Ala Ser Thr Lys Gly Pro Ser Val Phe Pro
            115                 120                 125
```

FIGURE 8 Continued...

```
Leu Ala Pro Cys Ser Arg Ser Thr Ser Glu Ser Thr Ala Ala Leu Gly
    130             135             140

Cys Leu Val Lys Asp Tyr Phe Pro Glu Pro Val Thr Val Ser Trp Asn
145             150             155             160

Ser Gly Ala Leu Thr Ser Gly Val His Thr Phe Pro Ala Val Leu Gln
                165             170             175

Ser Ser Gly Leu Tyr Ser Leu Ser Ser Val Val Thr Val Pro Ser Ser
            180             185             190

Ser Leu Gly Thr Lys Thr Tyr Thr Cys Asn Val Asp His Lys Pro Ser
        195             200             205

Asn Thr Lys Val Asp Lys Arg Val Glu Ser Lys Tyr Gly Pro Pro Cys
    210             215             220

Pro Pro Cys Pro Ala Pro Glu Phe Leu Gly Gly Pro Ser Val Phe Leu
225             230             235             240

Phe Pro Pro Lys Pro Lys Asp Thr Leu Met Ile Ser Arg Thr Pro Glu
            245             250             255

Val Thr Cys Val Val Val Asp Val Ser Gln Glu Asp Pro Glu Val Gln
            260             265             270

Phe Asn Trp Tyr Val Asp Gly Val Glu Val His Asn Ala Lys Thr Lys
        275             280             285

Pro Arg Glu Glu Gln Phe Asn Ser Thr Tyr Arg Val Val Ser Val Leu
    290             295             300

Thr Val Leu His Gln Asp Trp Leu Asn Gly Lys Glu Tyr Lys Cys Lys
305             310             315             320

Val Ser Asn Lys Gly Leu Pro Ser Ser Ile Glu Lys Thr Ile Ser Lys
            325             330             335

Ala Lys Gly Gln Pro Arg Glu Pro Gln Val Tyr Thr Leu Pro Pro Ser
            340             345             350

Gln Glu Glu Met Thr Lys Asn Gln Val Ser Leu Thr Cys Leu Val Lys
            355             360             365
```

FIGURE 8 Continued...

```
Gly Phe Tyr Pro Ser Asp Ile Ala Val Glu Trp Glu Ser Asn Gly Gln
    370                 375                 380

Pro Glu Asn Asn Tyr Lys Thr Thr Pro Pro Val Leu Asp Ser Asp Gly
385                 390                 395                 400

Ser Phe Phe Leu Tyr Ser Arg Leu Thr Val Asp Lys Ser Arg Trp Gln
                405                 410                 415

Glu Gly Asn Val Phe Ser Cys Ser Val Met His Glu Ala Leu His Asn
                420                 425                 430

His Tyr Thr Gln Lys Ser Leu Ser Leu Ser Leu Gly
                435                 440
```

<210> 3
<211> 444
<212> PRT
<213> Artificial

<220>
<223> Miscellaneous construct

<400> 3

```
Gln Val Gln Leu Val Gln Ser Gly Ala Glu Val Lys Lys Pro Gly Ala
1               5                   10                  15

Ser Val Lys Val Ser Cys Lys Val Ser Gly Phe Pro Ile Lys Asp Thr
                20                  25                  30

Phe Gln His Trp Val Arg Gln Ala Pro Gly Lys Gly Leu Glu Trp Met
                35                  40                  45

Gly Trp Ser Asp Pro Glu Ile Gly Asp Thr Glu Tyr Ala Ser Lys Phe
    50                  55                  60

Gln Gly Arg Val Thr Met Thr Glu Asp Thr Ser Thr Asp Thr Ala Tyr
65                  70                  75                  80

Met Glu Leu Ser Ser Leu Arg Ser Glu Asp Thr Ala Val Tyr Tyr Cys
                85                  90                  95

Ala Thr Gly Asp Thr Thr Tyr Lys Phe Asp Phe Trp Gly Gln Gly Thr
                100                 105                 110

Thr Val Thr Val Ser Ser Ala Ser Thr Lys Gly Pro Ser Val Phe Pro
                115                 120                 125
```

FIGURE 8 Continued...

```
Leu Ala Pro Cys Ser Arg Ser Thr Ser Glu Ser Thr Ala Ala Leu Gly
    130             135             140

Cys Leu Val Lys Asp Tyr Phe Pro Glu Pro Val Thr Val Ser Trp Asn
145             150             155                         160

Ser Gly Ala Leu Thr Ser Gly Val His Thr Phe Pro Ala Val Leu Gln
                165             170             175

Ser Ser Gly Leu Tyr Ser Leu Ser Ser Val Val Thr Val Pro Ser Ser
            180             185             190

Ser Leu Gly Thr Lys Thr Tyr Thr Cys Asn Val Asp His Lys Pro Ser
        195             200             205

Asn Thr Lys Val Asp Lys Arg Val Glu Ser Lys Tyr Gly Pro Pro Cys
    210             215             220

Pro Pro Cys Pro Ala Pro Glu Phe Leu Gly Gly Pro Ser Val Phe Leu
225             230             235             240

Phe Pro Pro Lys Pro Lys Asp Thr Leu Met Ile Ser Arg Thr Pro Glu
            245             250             255

Val Thr Cys Val Val Val Asp Val Ser Gln Glu Asp Pro Glu Val Gln
        260             265             270

Phe Asn Trp Tyr Val Asp Gly Val Glu Val His Asn Ala Lys Thr Lys
    275             280             285

Pro Arg Glu Glu Gln Phe Asn Ser Thr Tyr Arg Val Val Ser Val Leu
290             295             300

Thr Val Leu His Gln Asp Trp Leu Asn Gly Lys Glu Tyr Lys Cys Lys
305             310             315             320

Val Ser Asn Lys Gly Leu Pro Ser Ser Ile Glu Lys Thr Ile Ser Lys
            325             330             335

Ala Lys Gly Gln Pro Arg Glu Pro Gln Val Tyr Thr Leu Pro Pro Ser
        340             345             350

Gln Glu Glu Met Thr Lys Asn Gln Val Ser Leu Thr Cys Leu Val Lys
    355             360             365
```

FIGURE 8 Continued...

```
Gly Phe Tyr Pro Ser Asp Ile Ala Val Glu Trp Ser Asn Gly Gln
        370                 375                 380

Pro Glu Asn Asn Tyr Lys Thr Thr Pro Pro Val Leu Asp Ser Asp Gly
385                 390                 395                 400

Ser Phe Phe Leu Tyr Ser Arg Leu Thr Val Asp Lys Ser Arg Trp Gln
                405                 410                 415

Glu Gly Asn Val Phe Ser Cys Ser Val Met His Glu Ala Leu His Asn
                420                 425                 430

His Tyr Thr Gln Lys Ser Leu Ser Leu Gly
                435                 440

<210>  4
<211>  450
<212>  PRT
<213>  Artificial

<220>
<223>  Miscellaneous construct

<400>  4

Glu Val Gln Leu Val Gln Ser Gly Ala Glu Val Lys Lys Pro Gly Glu
1               5                   10                  15

Ser Leu Lys Ile Ser Cys Lys Gly Ser Asp Phe Glu Ile Lys Asp Tyr
                20                  25                  30

Tyr Ile His Trp Val Arg Gln Met Pro Gly Lys Gly Leu Glu Trp Met
                35                  40                  45

Gly Gln Ile Asp Ala Glu Asp Gly Glu Thr Glu Tyr Ala Pro Arg Phe
        50                  55                  60

Gln Gly Gln Val Thr Ile Ser Ala Asp Lys Ser Ile Ser Thr Ala Tyr
65                  70                  75                  80

Leu Gln Trp Ser Ser Leu Lys Ala Ser Asp Thr Ala Met Tyr Tyr Cys
                85                  90                  95

Ala Arg Glu Gly Tyr Tyr Tyr Asp Gly Arg Asp Tyr Trp Tyr Phe Asp
                100                 105                 110

Val Trp Gly Gln Gly Thr Thr Val Thr Val Ser Ser Ala Ser Thr Lys
                115                 120                 125
```

FIGURE 8 Continued...

```
Gly Pro Ser Val Phe Pro Leu Ala Pro Cys Ser Arg Ser Thr Ser Glu
    130                 135                 140

Ser Thr Ala Ala Leu Gly Cys Leu Val Lys Asp Tyr Phe Pro Glu Pro
145                 150                 155                 160

Val Thr Val Ser Trp Asn Ser Gly Ala Leu Thr Ser Gly Val His Thr
                165                 170                 175

Phe Pro Ala Val Leu Gln Ser Ser Gly Leu Tyr Ser Leu Ser Ser Val
            180                 185                 190

Val Thr Val Pro Ser Ser Ser Leu Gly Thr Lys Thr Tyr Thr Cys Asn
        195                 200                 205

Val Asp His Lys Pro Ser Asn Thr Lys Val Asp Lys Arg Val Glu Ser
    210                 215                 220

Lys Tyr Gly Pro Pro Cys Pro Pro Cys Pro Ala Pro Glu Phe Leu Gly
225                 230                 235                 240

Gly Pro Ser Val Phe Leu Phe Pro Pro Lys Pro Lys Asp Thr Leu Met
                245                 250                 255

Ile Ser Arg Thr Pro Glu Val Thr Cys Val Val Val Asp Val Ser Gln
            260                 265                 270

Glu Asp Pro Glu Val Gln Phe Asn Trp Tyr Val Asp Gly Val Glu Val
        275                 280                 285

His Asn Ala Lys Thr Lys Pro Arg Glu Glu Gln Phe Asn Ser Thr Tyr
    290                 295                 300

Arg Val Val Ser Val Leu Thr Val Leu His Gln Asp Trp Leu Asn Gly
305                 310                 315                 320

Lys Glu Tyr Lys Cys Lys Val Ser Asn Lys Gly Leu Pro Ser Ser Ile
                325                 330                 335

Glu Lys Thr Ile Ser Lys Ala Lys Gly Gln Pro Arg Glu Pro Gln Val
            340                 345                 350

Tyr Thr Leu Pro Pro Ser Gln Glu Glu Met Thr Lys Asn Gln Val Ser
        355                 360                 365
```

FIGURE 8 Continued...

```
Leu Thr Cys Leu Val Lys Gly Phe Tyr Pro Ser Asp Ile Ala Val Glu
    370                 375                 380

Trp Glu Ser Asn Gly Gln Pro Glu Asn Asn Tyr Lys Thr Thr Pro Pro
385                 390                 395                 400

Val Leu Asp Ser Asp Gly Ser Phe Phe Leu Tyr Ser Arg Leu Thr Val
                405                 410                 415

Asp Lys Ser Arg Trp Gln Glu Gly Asn Val Phe Ser Cys Ser Val Met
            420                 425                 430

His Glu Ala Leu His Asn His Tyr Thr Gln Lys Ser Leu Ser Leu Ser
        435                 440                 445

Leu Gly
    450

<210> 5
<211> 214
<212> PRT
<213> Artificial

<220>
<223> Miscellaneous construct

<400> 5

Asp Ile Gln Met Thr Gln Ser Pro Ser Ser Leu Ser Ala Ser Val Gly
1               5                   10                  15

Asp Arg Val Thr Ile Thr Cys Ser Ala Ser Gln Gly Ile Gln Trp Tyr
            20                  25                  30

Leu Asn Trp Tyr Gln Gln Lys Pro Gly Lys Ala Pro Lys Leu Leu Ile
        35                  40                  45

Tyr Tyr Thr Ser Ser Leu His Ser Gly Val Pro Ser Arg Phe Ser Gly
    50                  55                  60

Ser Gly Ser Gly Thr Asp Phe Thr Leu Thr Ile Ser Ser Leu Gln Pro
65                  70                  75                  80

Glu Asp Phe Ala Thr Tyr Tyr Cys Gln Gln His Ser Lys Leu Pro Arg
                85                  90                  95

Thr Phe Gly Gly Gly Thr Lys Val Glu Ile Lys Arg Thr Val Ala Ala
                100                 105                 110
```

FIGURE 8 Continued...

```
Pro Ser Val Phe Ile Phe Pro Pro Ser Asp Glu Gln Leu Lys Ser Gly
        115                 120                 125

Thr Ala Ser Val Val Cys Leu Leu Asn Asn Phe Tyr Pro Arg Glu Ala
        130                 135                 140

Lys Val Gln Trp Lys Val Asp Asn Ala Leu Gln Ser Gly Asn Ser Gln
145                 150                 155                 160

Glu Ser Val Thr Glu Gln Asp Ser Lys Asp Ser Thr Tyr Ser Leu Ser
                165                 170                 175

Ser Thr Leu Thr Leu Ser Lys Ala Asp Tyr Glu Lys His Lys Val Tyr
                180                 185                 190

Ala Cys Glu Val Thr His Gln Gly Leu Ser Ser Pro Val Thr Lys Ser
        195                 200                 205

Phe Asn Arg Gly Glu Cys
        210

<210>  6
<211>  214
<212>  PRT
<213>  Artificial

<220>
<223>  Miscellaneous construct

<400>  6

Asp Ile Gln Met Thr Gln Ser Pro Ser Ser Leu Ser Ala Ser Val Gly
1               5                   10                  15

Asp Arg Val Thr Ile Thr Cys Lys Ala Ser Gln Asp Val His Thr Ala
                20                  25                  30

Val Ala Trp Tyr Gln Gln Lys Pro Gly Lys Ala Pro Lys Leu Leu Ile
        35                  40                  45

Tyr Trp Ala Ser Thr Arg Trp Thr Gly Val Pro Ser Arg Phe Ser Gly
    50                  55                  60

Ser Gly Ser Gly Thr Asp Phe Thr Leu Thr Ile Ser Ser Leu Gln Pro
65                  70                  75                  80

Glu Asp Phe Ala Thr Tyr Tyr Cys Gln Gln Tyr Ser Asp Tyr Pro Trp
                85                  90                  95
```

FIGURE 8 Continued...

```
Thr Phe Gly Gly Gly Thr Lys Val Glu Ile Lys Arg Thr Val Ala Ala
            100                 105                 110

Pro Ser Val Phe Ile Phe Pro Pro Ser Asp Glu Gln Leu Lys Ser Gly
        115                 120                 125

Thr Ala Ser Val Val Cys Leu Leu Asn Asn Phe Tyr Pro Arg Glu Ala
    130                 135                 140

Lys Val Gln Trp Lys Val Asp Asn Ala Leu Gln Ser Gly Asn Ser Gln
145                 150                 155                 160

Glu Ser Val Thr Glu Gln Asp Ser Lys Asp Ser Thr Tyr Ser Leu Ser
                165                 170                 175

Ser Thr Leu Thr Leu Ser Lys Ala Asp Tyr Glu Lys His Lys Val Tyr
            180                 185                 190

Ala Cys Glu Val Thr His Gln Gly Leu Ser Ser Pro Val Thr Lys Ser
        195                 200                 205

Phe Asn Arg Gly Glu Cys
    210

<210>   7
<211>   213
<212>   PRT
<213>   Artificial

<220>
<223>   Miscellaneous construct

<400>   7

Glu Ile Val Leu Thr Gln Ser Pro Ala Thr Leu Ser Leu Ser Pro Gly
1               5                   10                  15

Glu Arg Ala Thr Leu Ser Cys Ser Ala Ser Ser Ser Val Ser Tyr Ile
            20                  25                  30

His Trp Tyr Gln Gln Lys Pro Gly Gln Ala Pro Arg Leu Leu Ile Tyr
        35                  40                  45

Ser Thr Ser Glu Leu Ala Ser Gly Ile Pro Ala Arg Phe Ser Gly Ser
    50                  55                  60

Gly Ser Gly Thr Asp Phe Thr Leu Thr Ile Ser Ser Leu Glu Pro Glu
```

Asp Phe Ala Val Tyr Tyr Cys Gln Gln Leu Ser His Leu Pro Leu Thr
                        85                   90                   95

Phe Gly Gly Gly Thr Lys Val Glu Ile Lys Arg Thr Val Ala Ala Pro
                       100                  105                  110

Ser Val Phe Ile Phe Pro Pro Ser Asp Glu Gln Leu Lys Ser Gly Thr
                       115                  120                  125

Ala Ser Val Val Cys Leu Leu Asn Asn Phe Tyr Pro Arg Glu Ala Lys
                       130                  135                  140

Val Gln Trp Lys Val Asp Asn Ala Leu Gln Ser Gly Asn Ser Gln Glu
        145                  150                  155                  160

Ser Val Thr Glu Gln Asp Ser Lys Asp Ser Thr Tyr Ser Leu Ser Ser
                       165                  170                  175

Thr Leu Thr Leu Ser Lys Ala Asp Tyr Glu Lys His Lys Val Tyr Ala
                       180                  185                  190

Cys Glu Val Thr His Gln Gly Leu Ser Ser Pro Val Thr Lys Ser Phe
                       195                  200                  205

Asn Arg Gly Glu Cys
                       210
```

<210> 8
<211> 1332
<212> DNA
<213> Artificial

<220>
<223> Miscellaneous construct

<400> 8

| | | | | | |
|---|---|---|---|---|---|
| caggtgcagc | tggtgcagtc | tggggctgag | gtgaagaagc | ctgggtcctc | agtgaaggtt | 60 |
| tcctgcaagg | catctggata | cacattcact | gactactttc | tgaactgggt | gcgacaggcc | 120 |
| cctggacaag | ggcttgagtg | gatgggaact | atttatcctt | accatgatgg | tactacctac | 180 |
| tctcagaagt | tcaagggcag | agtcaccatt | accgcggaca | atccacgag | cacagcctac | 240 |
| atggagctga | gcagcctgag | atctgaggac | acggccgtgt | attactgtgc | gagagaggaa | 300 |
| gaggatggtc | agttcgacta | ctggggccaa | ggaaccacgg | tcaccgtctc | ctcagcctcc | 360 |
| accaagggcc | catcggtctt | cccgctagcg | ccctgctcca | ggagcacctc | cgagagcaca | 420 |

FIGURE 8 Continued...

```
gccgccctgg gctgcctggt caaggactac ttccccgaac cggtgacggt gtcgtggaac    480
tcaggcgccc tgaccagcgg cgtgcacacc ttcccggctg tcctacagtc ctcaggactc    540
tactccctca gcagcgtggt gaccgtgccc tccagcagct gggcacgaa  gacctacacc    600 tgcaacgtag atcacaagcc cagcaacacc aaggtggaca agagagttga gtccaaatat    660
ggtcccccat gcccaccctg cccagcacct gagttcctgg ggggaccatc agtcttcctg    720
ttccccccaa acccaagga  cactctcatg atctcccgga cccctgaggt cacgtgcgtg    780
gtggtggacg tgagccagga agaccccgag gtccagttca actggtacgt ggatggcgtg    840
gaggtgcata atgccaagac aaagccgcgg gaggagcagt tcaacagcac gtaccgtgtg    900
gtcagcgtcc tcaccgtcct gcaccaggac tggctgaacg gcaaggagta caagtgcaag    960
gtctccaaca aaggcctccc gtcctccatc gagaaaacca tctccaaagc caaagggcag   1020
ccccgagagc cacaggtgta caccctgccc ccatcccagg aggagatgac caagaaccag   1080
gtcagcctga cctgcctggt caaaggcttc taccccagcg acatcgccgt ggagtgggaa   1140
agcaatgggc agccggagaa caactacaag accacgcctc ccgtgctgga ctccgacggc   1200
tccttcttcc tctacagcag gctaaccgtg gacaagagca ggtggcagga ggggaatgtc   1260
ttctcatgct ccgtgatgca tgaggctctg cacaaccact acacacagaa gagcctctcc   1320
ctgtctctgg gt                                                       1332
```

<210> 9
<211> 1332
<212> DNA
<213> Artificial

<220>
<223> Miscellaneous construct

<400> 9

```
caggttcagc tggtgcagtc tggggctgag gtgaagaagc ctggggcctc agtgaaggtc     60
tcctgcaagg tttccggctt cccattaag  gacacctttc agcactgggt gcgacaggct    120
cctggaaaag gcttgagtg  gatgggatgg agcgatcctg agatcggtga tactgaatat    180
gcctcgaagt tccagggcag agtcaccatg accgaggaca catctacaga cacagcctac    240
atggagctga gcagcctgag atctgaggac acggccgtgt attactgtgc aacaggcgac    300
accacataca agtttgactt ctggggccaa gggaccacgg tcaccgtctc ctcagcctcc    360
accaagggcc catcggtctt cccgctagcg cctgctcca  ggagcacctc cgagagcaca    420
gccgccctgg gctgcctggt caaggactac ttccccgaac cggtgacggt gtcgtggaac    480
tcaggcgccc tgaccagcgg cgtgcacacc ttcccggctg tcctacagtc ctcaggactc    540
```

FIGURE 8 Continued...

```
tactccctca gcagcgtggt gaccgtgccc tccagcagct tgggcacgaa gacctacacc    600
tgcaacgtag atcacaagcc cagcaacacc aaggtggaca agagagttga gtccaaatat    660
ggtcccccat gcccaccctg cccagcacct gagttcctgg ggggaccatc agtcttcctg    720
ttcccccaa aacccaagga cactctcatg atctcccgga cccctgaggt cacgtgcgtg    780
gtggtggacg tgagccagga agaccccgag gtccagttca actggtacgt ggatggcgtg    840
gaggtgcata atgccaagac aaagccgcgg gaggagcagt tcaacagcac gtaccgtgtg    900
gtcagcgtcc tcaccgtcct gcaccaggac tggctgaacg gcaaggagta caagtgcaag    960
gtctccaaca aaggcctccc gtcctccatc gagaaaacca tctccaaagc caaagggcag   1020
ccccgagagc cacaggtgta caccctgccc ccatcccagg aggagatgac caagaaccag   1080
gtcagcctga cctgcctggt caaaggcttc taccccagcg acatcgccgt ggagtgggaa   1140
agcaatgggc agccggagaa caactacaag accacgcctc ccgtgctgga ctccgacggc   1200
tccttcttcc tctacagcag gctaaccgtg gacaagagca ggtggcagga ggggaatgtc   1260
ttctcatgct ccgtgatgca tgaggctctg cacaaccact acacacagaa gagcctctcc   1320
ctgtctctgg gt                                                      1332
```

```
<210> 10
<211> 1350
<212> DNA
<213> Artificial

<220>
<223> Miscellaneous construct

<400> 10
gaggtgcagc tggtgcagtc tggagcagag gtgaaaaagc ccggggagtc tctgaagatc     60
tcctgtaagg gttctgactt cgagattaaa gactactata tacattgggt gcgccagatg    120
cccgggaaag gcctggagtg gatggggcag attgatgctg aggatggtga aactgaatat    180
gccccgaggt tccagggcca ggtcaccatc tcagccgaca gtccatcag caccgcctac    240
ctgcagtgga gcagcctgaa ggcctcggac accgccatgt attactgtgc gagagagggt    300
tattactacg atgggcgcga ctactggtac ttcgatgtct ggggccaagg gaccacggtc    360
accgtctcct cagcctccac caagggccca tcggtcttcc cgctagcgcc ctgctccagg    420
agcacctccg agagcacagc cgccctgggc tgcctggtca aggactactt ccccgaaccg    480
gtgacggtgt cgtggaactc aggcgccctg accagcggcg tgcacacctt cccggctgtc    540
ctacagtcct caggactcta ctccctcagc agcgtggtga ccgtgccctc cagcagcttg    600
ggcacgaaga cctacacctg caacgtagat cacaagccca gcaacaccaa ggtggacaag    660
agagttgagt ccaaatatgg tcccccatgc ccaccctgcc cagcacctga gttcctgggg    720
```

FIGURE 8 Continued...

```
ggaccatcag tcttcctgtt cccccaaaa cccaaggaca ctctcatgat ctcccggacc    780
cctgaggtca cgtgcgtggt ggtggacgtg agccaggaag accccgaggt ccagttcaac    840
tggtacgtgg atggcgtgga ggtgcataat gccaagacaa agccgcggga ggagcagttc    900
aacagcacgt accgtgtggt cagcgtcctc accgtcctgc accaggactg gctgaacggc    960
aaggagtaca agtgcaaggt ctccaacaaa ggcctcccgt cctccatcga gaaaaccatc   1020
tccaaagcca aagggcagcc ccgagagcca caggtgtaca ccctgccccc atcccaggag   1080
gagatgacca gaaccaggt cagcctgacc tgcctggtca aaggcttcta ccccagcgac   1140
atcgccgtgg agtgggaaag caatgggcag ccggagaaca actacaagac cacgcctccc   1200
gtgctggact ccgacggctc cttcttcctc tacagcaggc taaccgtgga caagagcagg   1260
tggcaggagg ggaatgtctt ctcatgctcc gtgatgcatg aggctctgca caaccactac   1320
acacagaaga gcctctccct gtctctgggt                                   1350
```

```
<210>   11
<211>   642
<212>   DNA
<213>   Artificial

<220>
<223>   Miscellaneous construct

<400>   11
gacatccaga tgacccagtc tccatcctct ctgtctgcat ctgtaggaga cagagtcacc     60
atcacttgca gtgcaagtca gggcattcag tggtatttaa actggtatca gcagaaacca    120
gggaaagccc ctaagctcct gatctattac acatcaagtt tacactcagg ggtcccatca    180
aggttcagtg gcagtggatc tgggacagat ttcactctca ccatcagcag tctgcaacct    240
gaagattttg caacttacta ctgtcagcag catagtaaac ttcctcggac gttcggcgga    300
gggaccaagg tggagatcaa acggactgtg gctgcaccat ctgtcttcat cttcccgcca    360
tctgatgagc agttgaaatc tggaactgcc tctgttgtgt gcctgctgaa taacttctat    420
cccagagagg ccaaagtaca gtggaaggtg gataacgccc tccaatcggg taactcccag    480
gagagtgtca cagagcagga cagcaaggac agcacctaca gcctcagcag cacctgacg    540
ctgagcaaag cagactacga gaaacacaaa gtctacgcct gcgaagtcac ccatcagggc    600
ctgagctcgc ccgtcacaaa gagcttcaac aggggagagt gc                      642
```

```
<210>   12
<211>   642
<212>   DNA
<213>   Artificial
```

FIGURE 8 Continued...

```
<220>
<223>  Miscellaneous construct

<400>  12
gacatccaga tgacccagtc tccatcctcc ctgtctgcat ctgtaggaga cagagtcacc    60
atcacttgca aggccagtca ggatgtgcac actgctgtag cctggtatca gcagaaacca   120
gggaaagccc ctaagctcct gatctattgg gcatccaccc ggtggactgg agtcccatca   180
aggttcagtg gcagtggatc tgggacagat ttcactctca ccatcagcag tctgcaacct   240
gaagattttg caacttacta ctgtcagcaa tatagcgatt atccgtggac gttcggcgga   300
gggaccaagg tggagatcaa acggactgtg gctgcaccat ctgtcttcat cttcccgcca   360
tctgatgagc agttgaaatc tggaactgcc tctgttgtgt gcctgctgaa taacttctat   420
cccagagagg ccaaagtaca gtggaaggtg gataacgccc tccaatcggg taactcccag   480
gagagtgtca cagagcagga cagcaaggac agcacctaca gcctcagcag caccctgacg   540
ctgagcaaag cagactacga gaaacacaaa gtctacgcct gcgaagtcac ccatcagggc   600
ctgagctcgc ccgtcacaaa gagcttcaac aggggagagt gc                      642

<210>  13
<211>  639
<212>  DNA
<213>  Artificial

<220>
<223>  Miscellaneous construct

<400>  13
gaaattgtgt tgacacagtc tccagccacc ctgtctttgt ctccagggga aagagccacc    60
ctctcctgca gtgccagctc aagtgtaagt tacatccact ggtaccaaca gaaacctggc   120
caggctccca ggctcctcat ctatagcaca tccgagctgg cttctggcat cccagccagg   180
ttcagtggca gtgggtctgg gacagacttc actctcacca tcagcagcct agagcctgaa   240
gattttgcag tttattactg tcagcagctt agtcatctcc cgctcacgtt cggcggaggg   300
accaaggtgg agatcaaacg aactgtggct gcaccatctg tcttcatctt cccgccatct   360
gatgagcagt tgaaatctgg aactgcctct gttgtgtgcc tgctgaataa cttctatccc   420
agagaggcca agtacagtg gaaggtggat aacgcctcc aatcgggtaa ctcccaggag   480
agtgtcacag agcaggacag caaggacagc acctacagcc tcagcagcac cctgacgctg   540
agcaaagcag actacgagaa acacaaagtc tacgcctgcg aagtcaccca tcagggcctg   600
agctcgcccg tcacaaagag cttcaacagg ggagagtgc                          639

```
<212>  PRT
<213>  Artificial

<220>
<223>  Miscellaneous construct

<400>  14

Gln Val Gln Leu Val Gln Ser Gly Ala Glu Val Lys Lys Pro Gly Ser
1               5                   10                  15

Ser Val Lys Val Ser Cys Lys Ala Ser Gly Tyr Thr Phe Thr Asp Tyr
                20                  25                  30

Phe Leu Asn Trp Val Arg Gln Ala Pro Gly Gln Gly Leu Glu Trp Met
                35                  40                  45

Gly Thr Ile Tyr Pro Tyr His Asp Gly Thr Thr Tyr Ser Gln Lys Phe
            50                  55                  60

Lys Gly Arg Val Thr Ile Thr Ala Asp Lys Ser Thr Ser Thr Ala Tyr
65                  70                  75                  80

Met Glu Leu Ser Ser Leu Arg Ser Glu Asp Thr Ala Val Tyr Tyr Cys
                85                  90                  95

Ala Arg Glu Glu Glu Asp Gly Gln Phe Asp Tyr Trp Gly Gln Gly Thr
                100                 105                 110

Thr Val Thr Val Ser Ser
            115

<210>  15
<211>  118
<212>  PRT
<213>  Artificial

<220>
<223>  Miscellaneous construct

<400>  15

Gln Val Gln Leu Val Gln Ser Gly Ala Glu Val Lys Lys Pro Gly Ala
1               5                   10                  15

Ser Val Lys Val Ser Cys Lys Val Ser Gly Phe Pro Ile Lys Asp Thr
                20                  25                  30

Phe Gln His Trp Val Arg Gln Ala Pro Gly Lys Gly Leu Glu Trp Met
                35                  40                  45
```

FIGURE 8 Continued...

```
Gly Trp Ser Asp Pro Glu Ile Gly Asp Thr Glu Tyr Ala Ser Lys Phe
    50                  55                  60

Gln Gly Arg Val Thr Met Thr Glu Asp Thr Ser Thr Asp Thr Ala Tyr
65                  70                  75                  80

Met Glu Leu Ser Ser Leu Arg Ser Glu Asp Thr Ala Val Tyr Tyr Cys
                85                  90                  95

Ala Thr Gly Asp Thr Thr Tyr Lys Phe Asp Phe Trp Gly Gln Gly Thr
            100                 105                 110

Thr Val Thr Val Ser Ser
        115

<210>  16
<211>  124
<212>  PRT
<213>  Artificial

<220>
<223>  Miscellaneous construct

<400>  16

Glu Val Gln Leu Val Gln Ser Gly Ala Glu Val Lys Lys Pro Gly Glu
1               5                   10                  15

Ser Leu Lys Ile Ser Cys Lys Gly Ser Asp Phe Glu Ile Lys Asp Tyr
                20                  25                  30

Tyr Ile His Trp Val Arg Gln Met Pro Gly Lys Gly Leu Glu Trp Met
            35                  40                  45

Gly Gln Ile Asp Ala Glu Asp Gly Glu Thr Glu Tyr Ala Pro Arg Phe
    50                  55                  60

Gln Gly Gln Val Thr Ile Ser Ala Asp Lys Ser Ile Ser Thr Ala Tyr
65                  70                  75                  80

Leu Gln Trp Ser Ser Leu Lys Ala Ser Asp Thr Ala Met Tyr Tyr Cys
                85                  90                  95

Ala Arg Glu Gly Tyr Tyr Tyr Asp Gly Arg Asp Tyr Trp Tyr Phe Asp
            100                 105                 110

Val Trp Gly Gln Gly Thr Thr Val Thr Val Ser Ser
        115                 120
```

FIGURE 8 Continued...

```
<210>  17
<211>  107
<212>  PRT
<213>  Artificial

<220>
<223>  Miscellaneous construct

<400>  17
```

Asp Ile Gln Met Thr Gln Ser Pro Ser Ser Leu Ser Ala Ser Val Gly
1               5                   10                  15

Asp Arg Val Thr Ile Thr Cys Ser Ala Ser Gln Gly Ile Gln Trp Tyr
            20                  25                  30

Leu Asn Trp Tyr Gln Gln Lys Pro Gly Lys Ala Pro Lys Leu Leu Ile
        35                  40                  45

Tyr Tyr Thr Ser Ser Leu His Ser Gly Val Pro Ser Arg Phe Ser Gly
    50                  55                  60

Ser Gly Ser Gly Thr Asp Phe Thr Leu Thr Ile Ser Ser Leu Gln Pro
65                  70                  75                  80

Glu Asp Phe Ala Thr Tyr Tyr Cys Gln Gln His Ser Lys Leu Pro Arg
                85                  90                  95

Thr Phe Gly Gly Gly Thr Lys Val Glu Ile Lys
                100                 105

```
<210>  18
<211>  107
<212>  PRT
<213>  Artificial

<220>
<223>  Miscellaneous construct

<400>  18
```

Asp Ile Gln Met Thr Gln Ser Pro Ser Ser Leu Ser Ala Ser Val Gly
1               5                   10                  15

Asp Arg Val Thr Ile Thr Cys Lys Ala Ser Gln Asp Val His Thr Ala
            20                  25                  30

Val Ala Trp Tyr Gln Gln Lys Pro Gly Lys Ala Pro Lys Leu Leu Ile
        35                  40                  45

FIGURE 8 Continued...

```
Tyr Trp Ala Ser Thr Arg Trp Thr Gly Val Pro Ser Arg Phe Ser Gly
    50                  55                  60

Ser Gly Ser Gly Thr Asp Phe Thr Leu Thr Ile Ser Ser Leu Gln Pro
65                  70                  75                  80

Glu Asp Phe Ala Thr Tyr Tyr Cys Gln Gln Tyr Ser Asp Tyr Pro Trp
                85                  90                  95

Thr Phe Gly Gly Gly Thr Lys Val Glu Ile Lys
                100                 105

<210>  19
<211>  106
<212>  PRT
<213>  Artificial

<220>
<223>  Miscellaneous construct

<400>  19

Glu Ile Val Leu Thr Gln Ser Pro Ala Thr Leu Ser Leu Ser Pro Gly
1               5                   10                  15

Glu Arg Ala Thr Leu Ser Cys Ser Ala Ser Ser Ser Val Ser Tyr Ile
                20                  25                  30

His Trp Tyr Gln Gln Lys Pro Gly Gln Ala Pro Arg Leu Leu Ile Tyr
            35                  40                  45

Ser Thr Ser Glu Leu Ala Ser Gly Ile Pro Ala Arg Phe Ser Gly Ser
    50                  55                  60

Gly Ser Gly Thr Asp Phe Thr Leu Thr Ile Ser Ser Leu Glu Pro Glu
65                  70                  75                  80

Asp Phe Ala Val Tyr Tyr Cys Gln Gln Leu Ser His Leu Pro Leu Thr
                85                  90                  95

Phe Gly Gly Gly Thr Lys Val Glu Ile Lys
                100                 105

<210>  20
<211>  10
<212>  PRT
<213>  Artificial

```
<223>  Miscellaneous construct

<400>  20

Gly Tyr Thr Phe Thr Asp Tyr Phe Leu Asn
1               5                   10

<210>  21
<211>  17
<212>  PRT
<213>  Artificial

<220>
<223>  Miscellaneous construct

<400>  21

Thr Ile Tyr Pro Tyr His Asp Gly Thr Thr Tyr Ser Gln Lys Phe Lys
1               5                   10                  15

Gly

<210>  22
<211>  9
<212>  PRT
<213>  Artificial

<220>
<223>  Miscellaneous construct

<400>  22

Glu Glu Glu Asp Gly Gln Phe Asp Tyr
1               5

<210>  23
<211>  11
<212>  PRT
<213>  Artificial

<220>
<223>  Miscellaneous construct

<400>  23

Ser Ala Ser Gln Gly Ile Gln Trp Tyr Leu Asn
1               5                   10

<210>  24
<211>  7
<212>  PRT
<213>  Artificial

<220>
<223>  Miscellaneous construct
```

Tyr Thr Ser Ser Leu His Ser
1               5

<210> 25
<211> 9
<212> PRT
<213> Artificial

<220>
<223> Miscellaneous construct

<400> 25

Gln Gln His Ser Lys Leu Pro Arg Thr
1               5

<210> 26
<211> 10
<212> PRT
<213> Artificial

<220>
<223> Miscellaneous construct

<400> 26

Gly Phe Pro Ile Lys Asp Thr Phe Gln His
1               5                   10

<210> 27
<211> 17
<212> PRT
<213> Artificial

<220>
<223> Miscellaneous construct

<400> 27

Trp Ser Asp Pro Glu Ile Gly Asp Thr Glu Tyr Ala Ser Lys Phe Gln
1               5                   10                  15

Gly

<210> 28
<211> 9
<212> PRT
<213> Artificial

<220>
<223> Miscellaneous construct
```

Gly Asp Thr Thr Tyr Lys Phe Asp Phe
1               5

<210>  29
<211>  11
<212>  PRT
<213>  Artificial

<220>
<223>  Miscellaneous construct

<400>  29

Lys Ala Ser Gln Asp Val His Thr Ala Val Ala
1               5                   10

<210>  30
<211>  7
<212>  PRT
<213>  Artificial

<220>
<223>  Miscellaneous construct

<400>  30

Trp Ala Ser Thr Arg Trp Thr
1               5

<210>  31
<211>  9
<212>  PRT
<213>  Artificial

<220>
<223>  Miscellaneous construct

<400>  31

Gln Gln Tyr Ser Asp Tyr Pro Trp Thr
1               5

<210>  32
<211>  10
<212>  PRT
<213>  Artificial

<220>
<223>  Miscellaneous construct

<400>  32

Asp Phe Glu Ile Lys Asp Tyr Tyr Ile His
1               5                   10
```

FIGURE 8 Continued...

```
<210>  33
<211>  17
<212>  PRT
<213>  Artificial

<220>
<223>  Miscellaneous construct

<400>  33
```

Gln Ile Asp Ala Glu Asp Gly Glu Thr Glu Tyr Ala Pro Arg Phe Gln
1               5                   10                  15

Gly

```
<210>  34
<211>  17
<212>  PRT
<213>  Artificial

<220>
<223>  Miscellaneous construct

<400>  34
```

Gln Ile Asp Ala Glu Asp Gly Glu Thr Glu Tyr Ala Pro Arg Phe Gln
1               5                   10                  15

Gly

```
<210>  35
<211>  17
<212>  PRT
<213>  Artificial

<220>
<223>  Miscellaneous construct

<400>  35
```

Gln Ile Asp Ala Glu Asp Gly Glu Thr Glu Tyr Ala Pro Arg Phe Gln
1               5                   10                  15

Gly

```
<210>  36
<211>  7
<212>  PRT
<213>  Artificial

```
<223>  Miscellaneous construct

<400>  36

Ser Thr Ser Glu Leu Ala Ser
1               5

<210>  37
<211>  9
<212>  PRT
<213>  Artificial

<220>
<223>  Miscellaneous construct

<400>  37

Gln Gln Leu Ser His Leu Pro Leu Thr
1               5

<210>  38
<211>  322
<212>  PRT
<213>  Artificial

<220>
<223>  Miscellaneous construct

<400>  38

Gly Pro Ser Val Phe Pro Leu Ala Pro Cys Ser Arg Ser Thr Ser Glu
1               5                   10                  15

Ser Thr Ala Ala Leu Gly Cys Leu Val Lys Asp Tyr Phe Pro Glu Pro
                20                  25                  30

Val Thr Val Ser Trp Asn Ser Gly Ala Leu Thr Ser Gly Val His Thr
                35                  40                  45

Phe Pro Ala Val Leu Gln Ser Ser Gly Leu Tyr Ser Leu Ser Ser Val
        50                  55                  60

Val Thr Val Pro Ser Ser Ser Leu Gly Thr Lys Thr Tyr Thr Cys Asn
65                  70                  75                  80

Val Asp His Lys Pro Ser Asn Thr Lys Val Asp Lys Arg Val Glu Ser
                85                  90                  95

Lys Tyr Gly Pro Pro Cys Pro Pro Cys Pro Ala Pro Glu Phe Leu Gly
                100                 105                 110

Gly Pro Ser Val Phe Leu Phe Pro Pro Lys Pro Lys Asp Thr Leu Met
```

Ile Ser Arg Thr Pro Glu Val Thr Cys Val Val Val Asp Val Ser Gln
            130                 135                 140

Glu Asp Pro Glu Val Gln Phe Asn Trp Tyr Val Asp Gly Val Glu Val
    145                 150                 155                 160

His Asn Ala Lys Thr Lys Pro Arg Glu Glu Gln Phe Asn Ser Thr Tyr
                    165                 170                 175

Arg Val Val Ser Val Leu Thr Val Leu His Gln Asp Trp Leu Asn Gly
                        180                 185                 190

Lys Glu Tyr Lys Cys Lys Val Ser Asn Lys Gly Leu Pro Ser Ser Ile
                    195                 200                 205

Glu Lys Thr Ile Ser Lys Ala Lys Gly Gln Pro Arg Glu Pro Gln Val
    210                 215                 220

Tyr Thr Leu Pro Pro Ser Gln Glu Glu Met Thr Lys Asn Gln Val Ser
    225                 230                 235                 240

Leu Thr Cys Leu Val Lys Gly Phe Tyr Pro Ser Asp Ile Ala Val Glu
                        245                 250                 255

Trp Glu Ser Asn Gly Gln Pro Glu Asn Asn Tyr Lys Thr Thr Pro Pro
                    260                 265                 270

Val Leu Asp Ser Asp Gly Ser Phe Phe Leu Tyr Ser Arg Leu Thr Val
                    275                 280                 285

Asp Lys Ser Arg Trp Gln Glu Gly Asn Val Phe Ser Cys Ser Val Met
                290                 295                 300

His Glu Ala Leu His Asn His Tyr Thr Gln Lys Ser Leu Ser Leu Ser
    305                 310                 315                 320

Leu Gly

<210>   39
    <211>   970
    <212>   DNA
    <213>   Artificial

<223> Miscellaneous construct

<400> 39

| | | | | | | |
|---|---|---|---|---|---|---|
| ggcccatcgg | tcttcccgct | agcgccctgc | tccaggagca | cctccgagag | cacagccgcc | 60 |
| ctgggctgcc | tggtcaagga | ctacttcccc | gaaccggtga | cggtgtcgtg | gaactcaggc | 120 |
| gccctgacca | gcggcgtgca | caccttcccg | gctgtcctac | agtcctcagg | actctactcc | 180 |
| gctcagcagc | gtggtgaccg | tgccctccag | cagcttgggc | acgaagacct | acacctgcaa | 240 |
| cgtagatcac | aagcccagca | acaccaaggt | ggacaagaga | gttgagtcca | aatatggtcc | 300 |
| cccatgccca | ccctgcccag | cacctgagtt | cctgggggga | ccatcagtct | tcctgttccc | 360 |
| cccaaaaccc | aaggacactc | tcatgatctc | ccggaccccct | gaggtcacgt | gcgtggtggt | 420 |
| ggacgtgagc | caggaagacc | ccgaggtcca | gttcaactgg | tacgtggatg | gcgtggaggt | 480 |
| gcataatgcc | aagacaaagc | cgcgggagga | gcagttcaac | agcacgtacc | gtgtggtcag | 540 |
| cgtcctcacc | gtcctgcacc | aggactggct | gaacggcaag | gagtacaagt | gcaaggtctc | 600 |
| caacaaaggc | ctcccgtcct | ccatcgagaa | aaccatctcc | aaagccaaag | ggcagccccg | 660 |
| agagccacag | gtgtacaccc | tgcccccatc | ccaggaggag | atgaccaaga | accaggtcag | 720 |
| cctgacctgc | ctggtcaaag | gcttctaccc | cagcgacatc | gccgtggagt | gggaaagcaa | 780 |
| tgggcagccg | gagaacaact | acaagaccac | gcctcccgtg | ctggactccg | acggctcctt | 840 |
| cttcctctac | agcaggctaa | ccgtggacaa | gagcaggtgg | caggagggga | atgtcttctc | 900 |
| atgctccgtg | atgcatgagg | ctctgcacaa | ccactacaca | cagaagagcc | tctccctgtc | 960 |
| tctgggttga | | | | | | 970 |

<210> 40
<211> 444
<212> PRT
<213> Artificial

<220>
<223> Miscellaneous construct

<400> 40

Glu Val Gln Leu Gln Ser Val Ala Glu Leu Val Arg Pro Gly Ala
1               5                   10                  15

Ser Val Lys Leu Ser Cys Thr Ala Ser Gly Phe Asn Ile Lys Ser Thr
              20                  25                  30

Phe Met His Trp Val Lys Gln Arg Pro Asp Gln Gly Leu Glu Trp Ile
          35                  40                  45

Gly Trp Ile Asp Pro Glu Asn Gly Asp Thr Glu Tyr Ala Ser Lys Phe

Gln Gly Lys Ala Thr Met Thr Ala Asp Thr Ser Ser Asn Thr Ala Tyr
65              70                  75                      80

Leu Gln Leu Ser Ser Leu Thr Ser Glu Asp Thr Ala Val Tyr Tyr Cys
                85                  90                      95

Thr Thr Gly Glu Ser Asn Tyr Asp Phe Asp Phe Trp Gly Leu Gly Thr
                100                 105                 110

Thr Leu Thr Val Ser Ser Ala Lys Thr Thr Pro Pro Ser Val Tyr Pro
            115                 120                 125

Leu Ala Pro Gly Thr Ala Leu Lys Ser Asn Ser Met Val Thr Leu Gly
        130                 135                 140

Cys Leu Val Lys Gly Tyr Phe Pro Glu Pro Val Thr Val Thr Trp Asn
145                 150                 155                 160

Ser Gly Ala Leu Ser Ser Gly Val His Thr Phe Pro Ala Val Leu Gln
                165                 170                 175

Ser Gly Leu Tyr Thr Leu Thr Ser Ser Val Thr Val Pro Ser Ser Thr
                180                 185                 190

Trp Pro Ser Gln Thr Val Thr Cys Asn Val Ala His Pro Ala Ser Ser
            195                 200                 205

Thr Lys Val Asp Lys Lys Ile Val Pro Arg Asn Cys Gly Gly Asp Cys
        210                 215                 220

Lys Pro Cys Ile Cys Thr Gly Ser Glu Val Ser Ser Val Phe Ile Phe
225                 230                 235                 240

Pro Pro Lys Pro Lys Asp Val Leu Thr Ile Thr Leu Thr Pro Lys Val
                245                 250                 255

Thr Cys Val Val Val Asp Ile Ser Gln Asp Asp Pro Glu Val His Phe
                260                 265                 270

Ser Trp Phe Val Asp Asp Val Glu Val His Thr Ala Gln Thr Arg Pro
            275                 280                 285

Pro Glu Glu Gln Phe Asn Ser Thr Phe Arg Ser Val Ser Glu Leu Pro
        290                 295                 300
```

FIGURE 8 Continued...

```
Ile Leu His Gln Asp Trp Leu Asn Gly Arg Thr Phe Arg Cys Lys Val
305                 310                 315                 320

Thr Ser Ala Ala Phe Pro Ser Pro Ile Glu Lys Thr Ile Ser Lys Pro
            325                 330                 335

Glu Gly Arg Thr Gln Val Pro His Val Tyr Thr Met Ser Pro Thr Lys
            340                 345                 350

Glu Glu Met Thr Gln Asn Glu Val Ser Ile Thr Cys Met Val Lys Gly
            355                 360                 365

Phe Tyr Pro Pro Asp Ile Tyr Val Glu Trp Gln Met Asn Gly Gln Pro
    370                 375                 380

Gln Glu Asn Tyr Lys Asn Thr Pro Pro Thr Met Asp Thr Asp Gly Ser
385                 390                 395                 400

Tyr Phe Leu Tyr Ser Lys Leu Asn Val Lys Lys Glu Lys Trp Gln Gln
            405                 410                 415

Gly Asn Thr Phe Thr Cys Ser Val Leu His Glu Gly Leu His Asn His
            420                 425                 430

His Thr Glu Lys Ser Leu Ser His Ser Pro Gly Lys
            435                 440
```

```
<210>  41
<211>  214
<212>  PRT
<213>  Artificial

<220>
<223>  Miscellaneous construct

<400>  41
```

```
Asp Ile Val Met Thr Gln Ser His Lys Phe Met Ser Thr Ser Val Gly
1               5                   10                  15

Asp Arg Val Ser Ile Thr Cys Lys Ala Ser Gln Asp Val Ser Thr Ala
            20                  25                  30

Val Ala Trp Tyr Gln Gln Lys Pro Gly Gln Ser Pro Lys Leu Leu Ile
            35                  40                  45

Tyr Trp Ala Ser Thr Arg His Thr Gly Val Pro Asp Arg Phe Thr Gly
```

Ser Gly Ser Gly Thr Asp Tyr Thr Leu Thr Ile Ser Asp Val Gln Ser
    65                  70                  75                  80

Glu Asp Leu Ala Asp Tyr Phe Cys Gln Gln Tyr Ser Asn Tyr Pro Trp
                        85                  90                  95

Thr Phe Gly Gly Gly Thr Lys Leu Glu Ile Lys Arg Ala Asp Ala Ala
                    100                 105                 110

Pro Thr Val Ser Ile Phe Pro Pro Ser Thr Glu Gln Leu Ala Thr Gly
                115                 120                 125

Gly Ala Ser Val Val Cys Leu Met Asn Asn Phe Tyr Pro Arg Asp Ile
            130                 135                 140

Ser Val Lys Trp Lys Ile Asp Gly Thr Glu Arg Arg Asp Gly Val Leu
    145                 150                 155                 160

Asp Ser Val Thr Asp Gln Asp Ser Lys Asp Ser Thr Tyr Ser Met Ser
                        165                 170                 175

Ser Thr Leu Ser Leu Ser Lys Ala Asp Tyr Glu Ser His Asn Leu Tyr
                    180                 185                 190

Thr Cys Glu Val Val His Lys Thr Ser Ser Ser Pro Val Val Lys Ser
                195                 200                 205

Phe Asn Arg Asn Glu Cys
            210

<210>  42
    <211>  450
    <212>  PRT
    <213>  Artificial

<220>
    <223>  Miscellaneous construct

<400>  42

Glu Val Gln Leu Gln Gln Ser Gly Ala Glu His Val Lys Pro Gly Ala
    1                   5                   10                  15

Ser Val Lys Leu Ser Cys Thr Ala Ser Asp Phe Asn Ile Lys Asp Tyr
                        20                  25                  30
```

FIGURE 8 Continued...

```
Tyr Ile His Trp Val Lys Gln Arg Thr Ala Gln Gly Leu Glu Trp Ile
        35                  40                  45

Gly Arg Ile Asp Pro Glu Asp Gly Glu Thr Glu Tyr Ala Pro Arg Phe
    50                  55                  60

Gln Gly Lys Ala Thr Ile Ile Ala Asp Thr Ser Ser Asn Thr Ala Tyr
65                  70                  75                  80

Leu Gln Leu Ser Ser Leu Thr Ser Glu Asp Thr Ala Val Tyr Tyr Cys
            85                  90                  95

Ala Arg Glu Gly Tyr Tyr Tyr Asp Ser Arg Asp Tyr Trp Tyr Phe Asp
                100                 105                 110

Val Trp Gly Thr Gly Thr Thr Val Thr Val Ser Ser Ala Lys Thr Thr
            115                 120                 125

Pro Pro Ser Val Tyr Pro Leu Ala Pro Gly Thr Ala Leu Lys Ser Asn
130                 135                 140

Ser Met Val Thr Leu Gly Cys Leu Val Lys Gly Tyr Phe Pro Glu Pro
145                 150                 155                 160

Val Thr Val Thr Trp Asn Ser Gly Ala Leu Ser Ser Gly Val His Thr
                165                 170                 175

Phe Pro Ala Val Leu Gln Ser Gly Leu Tyr Thr Leu Thr Ser Ser Val
            180                 185                 190

Thr Val Pro Ser Ser Thr Trp Pro Ser Gln Thr Val Thr Cys Asn Val
        195                 200                 205

Ala His Pro Ala Ser Ser Thr Lys Val Asp Lys Lys Ile Val Pro Arg
    210                 215                 220

Asn Cys Gly Gly Asp Cys Lys Pro Cys Ile Cys Thr Gly Ser Glu Val
225                 230                 235                 240

Ser Ser Val Phe Ile Phe Pro Pro Lys Pro Lys Asp Val Leu Thr Ile
                245                 250                 255

Thr Leu Thr Pro Lys Val Thr Cys Val Val Val Asp Ile Ser Gln Asp
            260                 265                 270

Asp Pro Glu Val His Phe Ser Trp Phe Val Asp Val Glu Val His
```

Thr Ala Gln Thr Arg Pro Pro Glu Glu Gln Phe Asn Ser Thr Phe Arg
            290                 295                 300

Ser Val Ser Glu Leu Pro Ile Leu His Gln Asp Trp Leu Asn Gly Arg
    305                 310                 315                 320

Thr Phe Arg Cys Lys Val Thr Ser Ala Ala Phe Pro Ser Pro Ile Glu
                    325                 330                 335

Lys Thr Ile Ser Lys Pro Glu Gly Arg Thr Gln Val Pro His Val Tyr
                340                 345                 350

Thr Met Ser Pro Thr Lys Glu Glu Met Thr Gln Asn Glu Val Ser Ile
                355                 360                 365

Thr Cys Met Val Lys Gly Phe Tyr Pro Pro Asp Ile Tyr Val Glu Trp
            370                 375                 380

Gln Met Asn Gly Gln Pro Gln Glu Asn Tyr Lys Asn Thr Pro Pro Thr
    385                 390                 395                 400

Met Asp Thr Asp Gly Ser Tyr Phe Leu Tyr Ser Lys Leu Asn Val Lys
                    405                 410                 415

Lys Glu Lys Trp Gln Gln Gly Asn Thr Phe Thr Cys Ser Val Leu His
                420                 425                 430

Glu Gly Leu His Asn His His Thr Glu Lys Ser Leu Ser His Ser Pro
                435                 440                 445

Gly Lys
        450

<210>  43
<211>  213
<212>  PRT
<213>  Artificial

<220>
<223>  Miscellaneous construct

<400>  43

Glu Ile Val Leu Thr Gln Ser Pro Ala Leu Met Ser Ala Ser Pro Gly
    1               5                   10                  15
```

FIGURE 8 Continued…

```
Glu Lys Val Thr Met Thr Cys Ser Ala Ser Ser Ser Val Ser Tyr Met
        20              25                  30

His Trp Phe Gln Gln Lys Pro Gly Thr Ser Pro Lys Leu Trp Ile Tyr
        35              40                  45

Ser Thr Ser Asn Leu Ala Ser Gly Val Pro Ala Arg Phe Ser Gly Ser
    50              55                  60

Gly Ser Gly Thr Ser Tyr Ser Leu Thr Ile Ser Ser Met Glu Ala Glu
65              70              75                  80

Asp Ala Ala Thr Tyr Tyr Cys Gln Gln Trp Ser Ser Asn Pro Leu Thr
                85              90                  95

Phe Gly Ala Gly Thr Lys Leu Glu Leu Lys Arg Ala Asp Ala Ala Pro
            100             105             110

Thr Val Ser Ile Phe Pro Pro Ser Thr Glu Gln Leu Ala Thr Gly Gly
        115             120             125

Ala Ser Val Val Cys Leu Met Asn Asn Phe Tyr Pro Arg Asp Ile Ser
    130             135             140

Val Lys Trp Lys Ile Asp Gly Thr Glu Arg Arg Asp Gly Val Leu Asp
145             150             155             160

Ser Val Thr Asp Gln Asp Ser Lys Asp Ser Thr Tyr Ser Met Ser Ser
            165             170             175

Thr Leu Ser Leu Ser Lys Ala Asp Tyr Glu Ser His Asn Leu Tyr Thr
            180             185             190

Cys Glu Val Val His Lys Thr Ser Ser Ser Pro Val Val Lys Ser Phe
        195             200             205

Asn Arg Asn Glu Cys
        210
```

FIGURE 9

SEQUENCE LISTING

<110>   Novartis AG

<120>   COMPOSITIONS AND METHODS OF USE FOR ANTIBODIES AGAINST SCLEROSTIN

<130>   52279

<160>   171

<170>   PatentIn version 3.2

<210>   1
<211>   10
<212>   PRT
<213>   Homo sapiens

<400>   1

Gly Phe Thr Phe Ser Ser Tyr Val Met Asn
1               5                   10

<210>   2
<211>   10
<212>   PRT
<213>   Homo sapiens

<400>   2

Gly Phe Thr Phe Arg Ser His Trp Leu Ser
1               5                   10

<210>   3
<211>   10
<212>   PRT
<213>   Homo sapiens

<400>   3

Gly Phe Thr Phe Ser Ser Tyr Val Met Asn
1               5                   10

<210>   4
<211>   10
<212>   PRT
<213>   Homo sapiens

Gly Phe Thr Phe Arg Ser His Trp Leu Ser
1               5                   10

<210> 5
<211> 10
<212> PRT
<213> Homo sapiens

<400> 5

Gly Phe Thr Phe Arg Ser His Trp Leu Ser
1               5                   10

<210> 6
<211> 10
<212> PRT
<213> Homo sapiens

<400> 6

Gly Phe Thr Phe Arg Ser His Trp Leu Ser
1               5                   10

<210> 7
<211> 10
<212> PRT
<213> Homo sapiens

<400> 7

Gly Phe Thr Phe Arg Ser His Trp Leu Ser
1               5                   10

<210> 8
<211> 10
<212> PRT
<213> Homo sapiens

<400> 8

Gly Phe Thr Phe Arg Ser His Trp Leu Ser
1               5                   10

<210> 9
<211> 10
<212> PRT
<213> Homo sapiens

<400> 9

Gly Phe Thr Phe Arg Ser His Trp Leu Ser
1               5                   10
```

FIGURE 9 Continued...

```
<210>  10
<211>  10
<212>  PRT
<213>  Homo sapiens

<400>  10

Gly Phe Thr Phe Arg Ser His Trp Leu Ser
1               5                   10

<210>  11
<211>  10
<212>  PRT
<213>  Homo sapiens

<400>  11

Gly Phe Thr Phe Arg Ser His Trp Leu Ser
1               5                   10

<210>  12
<211>  20
<212>  PRT
<213>  Homo sapiens

<400>  12

Trp Val Ser Phe Ile Ser Gly Asp Ser Ser Asn Thr Tyr Tyr Ala Asp
1               5                   10                  15

Ser Val Lys Gly
            20

<210>  13
<211>  20
<212>  PRT
<213>  Homo sapiens

<400>  13

Trp Val Ser Asn Ile Asn Tyr Asp Gly Ser Ser Thr Tyr Tyr Ala Asp
1               5                   10                  15

Ser Val Lys Gly
            20

<210>  14
<211>  20
<212>  PRT
<213>  Homo sapiens

<400>  14

Trp Val Ser Phe Ile Ser Gly Asp Ser Ser Asn Thr Tyr Tyr Ala Asp
```

Ser Val Lys Gly
            20

<210>   15
<211>   20
<212>   PRT
<213>   Homo sapiens

<400>   15

Trp Val Ser Asn Ile Asn Tyr Asp Gly Ser Ser Thr Tyr Tyr Ala Asp
1                   5                   10                  15

Ser Val Lys Gly
            20

<210>   16
<211>   19
<212>   PRT
<213>   Homo sapiens

<400>   16

Trp Val Ser Val Thr Gly Val His Gly Asp Thr Tyr Tyr Ala Asp Ser
1                   5                   10                  15

Val Lys Gly

<210>   17
<211>   19
<212>   PRT
<213>   Homo sapiens

<400>   17

Trp Val Ser Val Ile Gly Asn Trp Gly Asp Thr Tyr Tyr Ala Asp Ser
1                   5                   10                  15

Val Lys Gly

<210>   18
<211>   19
<212>   PRT
<213>   Homo sapiens

<400>   18

Trp Val Ser Val Thr Thr His Gln Gly Tyr Thr Tyr Tyr Ala Asp Ser
1                   5                   10                  15
```

FIGURE 9 Continued...

```
Val Lys Gly

<210>  19
<211>  19
<212>  PRT
<213>  Homo sapiens

<400>  19

Trp Val Ser Ala Thr Asn Arg Tyr Gly Tyr Thr Tyr Tyr Ala Asp Ser
1               5                   10                  15

Val Lys Gly

<210>  20
<211>  20
<212>  PRT
<213>  Homo sapiens

<400>  20

Trp Val Ser Asn Ile Asn Tyr Asp Gly Ser Ser Thr Tyr Tyr Ala Asp
1               5                   10                  15

Ser Val Lys Gly
            20

<210>  21
<211>  19
<212>  PRT
<213>  Homo sapiens

<400>  21

Trp Val Ser Val Ile Thr Pro Tyr Gly Asp Thr Tyr Tyr Ala Asp Ser
1               5                   10                  15

Val Lys Gly

<210>  22
<211>  19
<212>  PRT
<213>  Homo sapiens

<400>  22

Trp Val Ser Val Ile Thr Pro Tyr Gly Asp Thr Tyr Tyr Ala Asp Ser
1               5                   10                  15
```

FIGURE 9 Continued...

```
Val Lys Gly

<210>  23
<211>  15
<212>  PRT
<213>  Homo sapiens

<400>  23

Thr Phe Met His Gly His Leu Gly Gly Gly Leu Ser Met Asp Phe
1               5                   10                  15

<210>  24
<211>  8
<212>  PRT
<213>  Homo sapiens

<400>  24

Asp Thr Tyr Leu His Phe Asp Tyr
1               5

<210>  25
<211>  15
<212>  PRT
<213>  Homo sapiens

<400>  25

Thr Phe Met His Gly His Leu Gly Gly Leu Ser Met Asp Phe
1               5                   10                  15

<210>  26
<211>  8
<212>  PRT
<213>  Homo sapiens

<400>  26

Asp Thr Tyr Leu His Phe Asp Tyr
1               5

<210>  27
<211>  8
<212>  PRT
<213>  Homo sapiens

<400>  27

Asp Thr Tyr Leu His Phe Asp Tyr
1               5

```
<211>  8
<212>  PRT
<213>  Homo sapiens

<400>  28

Asp Thr Tyr Leu His Phe Asp Tyr
1               5

<210>  29
<211>  8
<212>  PRT
<213>  Homo sapiens

<400>  29

Asp Thr Tyr Leu His Phe Asp Tyr
1               5

<210>  30
<211>  8
<212>  PRT
<213>  Homo sapiens

<400>  30

Asp Thr Tyr Leu His Phe Asp Tyr
1               5

<210>  31
<211>  8
<212>  PRT
<213>  Homo sapiens

<400>  31

Asp Thr Tyr Leu His Phe Asp Tyr
1               5

<210>  32
<211>  8
<212>  PRT
<213>  Homo sapiens

<400>  32

Asp Thr Tyr Leu His Phe Asp Tyr
1               5

<210>  33
<211>  8
<212>  PRT
<213>  Homo sapiens

```
Asp Thr Tyr Leu His Phe Asp Tyr
1               5

<210> 34
<211> 11
<212> PRT
<213> Homo sapiens

<400> 34

Ser Gly Asp Asn Ile Gly Ser Phe Tyr Val His
1               5                   10

<210> 35
<211> 20
<212> PRT
<213> Homo sapiens

<400> 35

Trp Val Ser Asn Ile Asn Tyr Asp Gly Ser Ser Thr Tyr Tyr Ala Asp
1               5                   10                  15

Ser Val Lys Gly
            20

<210> 36
<211> 11
<212> PRT
<213> Homo sapiens

<400> 36

Ser Gly Asp Asn Ile Gly Ser Phe Tyr Val His
1               5                   10

<210> 37
<211> 14
<212> PRT
<213> Homo sapiens

<400> 37

Thr Gly Thr Ser Ser Asp Val Gly Asp Ile Asn Asp Val Ser
1               5                   10

<210> 38
<211> 14
<212> PRT
<213> Homo sapiens

<400> 38

Thr Gly Thr Ser Ser Asp Val Gly Asp Ile Asn Asp Val Ser
1               5                   10
```

FIGURE 9 Continued...

```
<210>  39
<211>  14
<212>  PRT
<213>  Homo sapiens

<400>  39

Thr Gly Thr Ser Ser Asp Val Gly Asp Ile Asn Asp Val Ser
1               5                   10

<210>  40
<211>  14
<212>  PRT
<213>  Homo sapiens

<400>  40

Thr Gly Thr Ser Ser Asp Val Gly Asp Ile Asn Asp Val Ser
1               5                   10

<210>  41
<211>  14
<212>  PRT
<213>  Homo sapiens

<400>  41

Thr Gly Thr Ser Ser Asp Val Gly Asp Ile Asn Asp Val Ser
1               5                   10

<210>  42
<211>  14
<212>  PRT
<213>  Homo sapiens

<400>  42

Thr Gly Thr Ser Ser Asp Val Gly Asp Ile Asn Asp Val Ser
1               5                   10

<210>  43
<211>  14
<212>  PRT
<213>  Homo sapiens

<400>  43

Thr Gly Thr Ser Ser Asp Val Gly Asp Ile Asn Asp Val Ser
1               5                   10

<210>  44
<211>  14
<212>  PRT
<213>  Homo sapiens
```

Thr Gly Thr Ser Ser Asp Val Gly Asp Ile Asn Asp Val Ser
1               5                   10

<210>  45
<211>  11
<212>  PRT
<213>  Homo sapiens

<400>  45

Leu Val Ile Tyr Asp Asp Asn Asn Arg Pro Ser
1               5                   10

<210>  46
<211>  11
<212>  PRT
<213>  Homo sapiens

<400>  46

Leu Met Ile Tyr Asp Val Asn Asn Arg Pro Ser
1               5                   10

<210>  47
<211>  11
<212>  PRT
<213>  Homo sapiens

<400>  47

Leu Val Ile Tyr Asp Asp Asn Asn Arg Pro Ser
1               5                   10

<210>  48
<211>  11
<212>  PRT
<213>  Homo sapiens

<400>  48

Leu Met Ile Tyr Asp Val Asn Asn Arg Pro Ser
1               5                   10

<210>  49
<211>  11
<212>  PRT
<213>  Homo sapiens

<400>  49

Leu Met Ile Tyr Asp Val Asn Asn Arg Pro Ser
1               5                   10
```

FIGURE 9 Continued...

```
<210>  50
<211>  11
<212>  PRT
<213>  Homo sapiens

<400>  50

Leu Met Ile Tyr Asp Val Asn Asn Arg Pro Ser
1               5                   10

<210>  51
<211>  11
<212>  PRT
<213>  Homo sapiens

<400>  51

Leu Met Ile Tyr Asp Val Asn Asn Arg Pro Ser
1               5                   10

<210>  52
<211>  11
<212>  PRT
<213>  Homo sapiens

<400>  52

Leu Met Ile Tyr Asp Val Asn Asn Arg Pro Ser
1               5                   10

<210>  53
<211>  11
<212>  PRT
<213>  Homo sapiens

<400>  53

Leu Met Ile Tyr Asp Val Asn Asn Arg Pro Ser
1               5                   10

<210>  54
<211>  11
<212>  PRT
<213>  Homo sapiens

<400>  54

Leu Met Ile Tyr Asp Val Asn Asn Arg Pro Ser
1               5                   10

<210>  55
<211>  11
<212>  PRT
<213>  Homo sapiens
```

Leu Met Ile Tyr Asp Val Asn Asn Arg Pro Ser
1               5                   10

<210>  56
<211>  10
<212>  PRT
<213>  Homo sapiens

<400>  56

Gly Ser Trp Ala Gly Ser Ser Gly Ser Tyr
1               5                   10

<210>  57
<211>  10
<212>  PRT
<213>  Homo sapiens

<400>  57

Ser Ser Tyr Gly Glu Ser Leu Thr Ser Tyr
1               5                   10

<210>  58
<211>  10
<212>  PRT
<213>  Homo sapiens

<400>  58

Ala Ser Trp Thr Gly Val Glu Pro Asp Tyr
1               5                   10

<210>  59
<211>  10
<212>  PRT
<213>  Homo sapiens

<400>  59

Gln Ser Tyr Ala Gly Ser Tyr Leu Ser Glu
1               5                   10

<210>  60
<211>  10
<212>  PRT
<213>  Homo sapiens

<400>  60

Ser Ser Tyr Gly Glu Ser Leu Thr Ser Tyr
1               5                   10
```

FIGURE 9 Continued...

```
<210>  61
<211>  10
<212>  PRT
<213>  Homo sapiens

<400>  61

Ser Ser Tyr Gly Glu Ser Leu Thr Ser Tyr
1               5                   10

<210>  62
<211>  10
<212>  PRT
<213>  Homo sapiens

<400>  62

Ser Ser Tyr Gly Glu Ser Leu Thr Ser Tyr
1               5                   10

<210>  63
<211>  10
<212>  PRT
<213>  Homo sapiens

<400>  63

Ser Ser Tyr Gly Glu Ser Leu Thr Ser Tyr
1               5                   10

<210>  64
<211>  10
<212>  PRT
<213>  Homo sapiens

<400>  64

Ser Thr Tyr Asp Gly Pro Gly Leu Ser Glu
1               5                   10

<210>  65
<211>  10
<212>  PRT
<213>  Homo sapiens

<400>  65

Ser Ser Tyr Gly Glu Ser Leu Thr Ser Tyr
1               5                   10

<210>  66
<211>  10
<212>  PRT
<213>  Homo sapiens

```
Ser Ser Tyr Gly Glu Ser Leu Thr Ser Tyr
1               5                   10

<210>  67
<211>  124
<212>  PRT
<213>  Homo sapiens

<400>  67

Gln Val Gln Leu Val Glu Ser Gly Gly Leu Val Gln Pro Gly Gly
1               5                   10                  15

Ser Leu Arg Leu Ser Cys Ala Ala Ser Gly Phe Thr Phe Ser Ser Tyr
            20                  25                  30

Val Met Asn Trp Val Arg Gln Ala Pro Gly Lys Gly Leu Glu Trp Val
            35                  40                  45

Ser Phe Ile Ser Gly Asp Ser Ser Asn Thr Tyr Tyr Ala Asp Ser Val
            50                  55                  60

Lys Gly Arg Phe Thr Ile Ser Arg Asp Asn Ser Lys Asn Thr Leu Tyr
65                  70                  75                  80

Leu Gln Met Asn Ser Leu Arg Ala Glu Asp Thr Ala Val Tyr Tyr Cys
            85                  90                  95

Ala Arg Thr Phe Met His Gly His Leu Gly Gly Gly Leu Ser Met Asp
            100                 105                 110

Phe Trp Gly Gln Gly Thr Leu Val Thr Val Ser Ser
            115                 120

<210>  68
<211>  117
<212>  PRT
<213>  Homo sapiens

<400>  68

Gln Val Gln Leu Val Glu Ser Gly Gly Gly Leu Val Gln Pro Gly Gly
1               5                   10                  15

Ser Leu Arg Leu Ser Cys Ala Ala Ser Gly Phe Thr Phe Arg Ser His
            20                  25                  30

Trp Leu Ser Trp Val Arg Gln Ala Pro Gly Lys Gly Leu Glu Trp Val
            35                  40                  45
```

FIGURE 9 Continued...

```
Ser Asn Ile Asn Tyr Asp Gly Ser Ser Thr Tyr Tyr Ala Asp Ser Val
    50                  55                  60

Lys Gly Arg Phe Thr Ile Ser Arg Asp Asn Ser Lys Asn Thr Leu Tyr
65                  70                  75                   80

Leu Gln Met Asn Ser Leu Arg Ala Glu Asp Thr Ala Val Tyr Tyr Cys
                85                  90                  95

Ala Arg Asp Thr Tyr Leu His Phe Asp Tyr Trp Gly Gln Gly Thr Leu
            100                 105                 110

Val Thr Val Ser Ser
        115

<210>  69
<211>  124
<212>  PRT
<213>  Homo sapiens

<400>  69

Gln Val Gln Leu Val Glu Ser Gly Gly Gly Leu Val Gln Pro Gly Gly
1               5                   10                  15

Ser Leu Arg Leu Ser Cys Ala Ala Ser Gly Phe Thr Phe Ser Ser Tyr
                20                  25                  30

Val Met Asn Trp Val Arg Gln Ala Pro Gly Lys Gly Leu Glu Trp Val
            35                  40                  45

Ser Phe Ile Ser Gly Asp Ser Ser Asn Thr Tyr Tyr Ala Asp Ser Val
        50                  55                  60

Lys Gly Arg Phe Thr Ile Ser Arg Asp Asn Ser Lys Asn Thr Leu Tyr
65                  70                  75                   80

Leu Gln Met Asn Ser Leu Arg Ala Glu Asp Thr Ala Val Tyr Tyr Cys
                85                  90                  95

Ala Arg Thr Phe Met His Gly His Leu Gly Gly Gly Leu Ser Met Asp
            100                 105                 110

Phe Trp Gly Gln Gly Thr Leu Val Thr Val Ser Ser
        115                 120
```

FIGURE 9 Continued...

```
<210>  70
<211>  117
<212>  PRT
<213>  Homo sapiens

<400>  70
```

| Gln | Val | Gln | Leu | Val | Glu | Ser | Gly | Gly | Gly | Leu | Val | Gln | Pro | Gly | Gly |
|---|---|---|---|---|---|---|---|---|---|---|---|---|---|---|---|
| 1 | | | | 5 | | | | | 10 | | | | | 15 | |

| Ser | Leu | Arg | Leu | Ser | Cys | Ala | Ala | Ser | Gly | Phe | Thr | Phe | Arg | Ser | His |
|---|---|---|---|---|---|---|---|---|---|---|---|---|---|---|---|
| | | | 20 | | | | | 25 | | | | | 30 | | |

| Trp | Leu | Ser | Trp | Val | Arg | Gln | Ala | Pro | Gly | Lys | Gly | Leu | Glu | Trp | Val |
|---|---|---|---|---|---|---|---|---|---|---|---|---|---|---|---|
| | | 35 | | | | | 40 | | | | | 45 | | | |

| Ser | Asn | Ile | Asn | Tyr | Asp | Gly | Ser | Ser | Thr | Tyr | Tyr | Ala | Asp | Ser | Val |
|---|---|---|---|---|---|---|---|---|---|---|---|---|---|---|---|
| 50 | | | | | 55 | | | | | 60 | | | | | |

| Lys | Gly | Arg | Phe | Thr | Ile | Ser | Arg | Asp | Asn | Ser | Lys | Asn | Thr | Leu | Tyr |
|---|---|---|---|---|---|---|---|---|---|---|---|---|---|---|---|
| 65 | | | | | 70 | | | | | 75 | | | | | 80 |

| Leu | Gln | Met | Asn | Ser | Leu | Arg | Ala | Glu | Asp | Thr | Ala | Val | Tyr | Tyr | Cys |
|---|---|---|---|---|---|---|---|---|---|---|---|---|---|---|---|
| | | | | 85 | | | | | 90 | | | | | 95 | |

| Ala | Arg | Asp | Thr | Tyr | Leu | His | Phe | Asp | Tyr | Trp | Gly | Gln | Gly | Thr | Leu |
|---|---|---|---|---|---|---|---|---|---|---|---|---|---|---|---|
| | | | 100 | | | | | 105 | | | | | 110 | | |

| Val | Thr | Val | Ser | Ser |
|---|---|---|---|---|
| | | 115 | | |

```
<210>  71
<211>  116
<212>  PRT
<213>  Homo sapiens

<400>  71
```

| Gln | Val | Gln | Leu | Val | Glu | Ser | Gly | Gly | Gly | Leu | Val | Gln | Pro | Gly | Gly |
|---|---|---|---|---|---|---|---|---|---|---|---|---|---|---|---|
| 1 | | | | 5 | | | | | 10 | | | | | 15 | |

| Ser | Leu | Arg | Leu | Ser | Cys | Ala | Ala | Ser | Gly | Phe | Thr | Phe | Arg | Ser | His |
|---|---|---|---|---|---|---|---|---|---|---|---|---|---|---|---|
| | | | 20 | | | | | 25 | | | | | 30 | | |

| Trp | Leu | Ser | Trp | Val | Arg | Gln | Ala | Pro | Gly | Lys | Gly | Leu | Glu | Trp | Val |
|---|---|---|---|---|---|---|---|---|---|---|---|---|---|---|---|
| | | 35 | | | | | 40 | | | | | 45 | | | |

| Ser | Val | Thr | Gly | Val | His | Gly | Asp | Thr | Tyr | Tyr | Ala | Asp | Ser | Val | Lys |
|---|---|---|---|---|---|---|---|---|---|---|---|---|---|---|---|
| 50 | | | | | 55 | | | | | 60 | | | | | |

FIGURE 9 Continued...

```
Gly Arg Phe Thr Ile Ser Arg Asp Asn Ser Lys Asn Thr Leu Tyr Leu
65                  70                  75                  80

Gln Met Asn Ser Leu Arg Ala Glu Asp Thr Ala Val Tyr Tyr Cys Ala
                85                  90                  95

Arg Asp Thr Tyr Leu His Phe Asp Tyr Trp Gly Gln Gly Thr Leu Val
            100                 105                 110

Thr Val Ser Ser
        115

<210>   72
<211>   116
<212>   PRT
<213>   Homo sapiens

<400>   72

Gln Val Gln Leu Val Glu Ser Gly Gly Leu Val Gln Pro Gly Gly
1               5                   10                  15

Ser Leu Arg Leu Ser Cys Ala Ala Ser Gly Phe Thr Phe Arg Ser His
                20                  25                  30

Trp Leu Ser Trp Val Arg Gln Ala Pro Gly Lys Gly Leu Glu Trp Val
            35                  40                  45

Ser Val Ile Gly Asn Trp Gly Asp Thr Tyr Tyr Ala Asp Ser Val Lys
        50                  55                  60

Gly Arg Phe Thr Ile Ser Arg Asp Asn Ser Lys Asn Thr Leu Tyr Leu
65                  70                  75                  80

Gln Met Asn Ser Leu Arg Ala Glu Asp Thr Ala Val Tyr Tyr Cys Ala
                85                  90                  95

Arg Asp Thr Tyr Leu His Phe Asp Tyr Trp Gly Gln Gly Thr Leu Val
            100                 105                 110

Thr Val Ser Ser
        115

<210>   73
<211>   116
<212>   PRT
<213>   Homo sapiens
```

Gln Val Gln Leu Val Glu Ser Gly Gly Gly Leu Val Gln Pro Gly Gly
1               5                   10                  15

Ser Leu Arg Leu Ser Cys Ala Ala Ser Gly Phe Thr Phe Arg Ser His
            20                  25                  30

Trp Leu Ser Trp Val Arg Gln Ala Pro Gly Lys Gly Leu Glu Trp Val
        35                  40                  45

Ser Val Thr Thr His Gln Gly Tyr Thr Tyr Tyr Ala Asp Ser Val Lys
    50                  55                  60

Gly Arg Phe Thr Ile Ser Arg Asp Asn Ser Lys Asn Thr Leu Tyr Leu
65                  70                  75                  80

Gln Met Asn Ser Leu Arg Ala Glu Asp Thr Ala Val Tyr Tyr Cys Ala
                85                  90                  95

Arg Asp Thr Tyr Leu His Phe Asp Tyr Trp Gly Gln Gly Thr Leu Val
                100                 105                 110

Thr Val Ser Ser
            115

<210>  74
<211>  116
<212>  PRT
<213>  Homo sapiens

<400>  74

Gln Val Gln Leu Val Glu Ser Gly Gly Gly Leu Val Gln Pro Gly Gly
1               5                   10                  15

Ser Leu Arg Leu Ser Cys Ala Ala Ser Gly Phe Thr Phe Arg Ser His
            20                  25                  30

Trp Leu Ser Trp Val Arg Gln Ala Pro Gly Lys Gly Leu Glu Trp Val
        35                  40                  45

Ser Ala Thr Asn Arg Tyr Gly Tyr Thr Tyr Tyr Ala Asp Ser Val Lys
    50                  55                  60

Gly Arg Phe Thr Ile Ser Arg Asp Asn Ser Lys Asn Thr Leu Tyr Leu
65                  70                  75                  80
```

FIGURE 9 Continued...

```
Gln Met Asn Ser Leu Arg Ala Glu Asp Thr Ala Val Tyr Tyr Cys Ala
                 85                  90                  95

Arg Asp Thr Tyr Leu His Phe Asp Tyr Trp Gly Gln Gly Thr Leu Val
             100                 105                 110

Thr Val Ser Ser
            115

<210>  75
<211>  117
<212>  PRT
<213>  Homo sapiens

<400>  75

Gln Val Gln Leu Val Glu Ser Gly Gly Gly Leu Val Gln Pro Gly Gly
1               5                   10                  15

Ser Leu Arg Leu Ser Cys Ala Ala Ser Gly Phe Thr Phe Arg Ser His
             20                  25                  30

Trp Leu Ser Trp Val Arg Gln Ala Pro Gly Lys Gly Leu Glu Trp Val
             35                  40                  45

Ser Asn Ile Asn Tyr Asp Gly Ser Ser Thr Tyr Tyr Ala Asp Ser Val
         50                  55                  60

Lys Gly Arg Phe Thr Ile Ser Arg Asp Asn Ser Lys Asn Thr Leu Tyr
65                  70                  75                  80

Leu Gln Met Asn Ser Leu Arg Ala Glu Asp Thr Ala Val Tyr Tyr Cys
                 85                  90                  95

Ala Arg Asp Thr Tyr Leu His Phe Asp Tyr Trp Gly Gln Gly Thr Leu
             100                 105                 110

Val Thr Val Ser Ser
            115

<210>  76
<211>  116
<212>  PRT
<213>  Homo sapiens

<400>  76

Gln Val Gln Leu Val Glu Ser Gly Gly Gly Leu Val Gln Pro Gly Gly
1               5                   10                  15
```

FIGURE 9 Continued...

```
Ser Leu Arg Leu Ser Cys Ala Ala Ser Gly Phe Thr Phe Arg Ser His
            20                  25                  30

Trp Leu Ser Trp Val Arg Gln Ala Pro Gly Lys Gly Leu Glu Trp Val
        35                  40                  45

Ser Val Ile Thr Pro Tyr Gly Asp Thr Tyr Tyr Ala Asp Ser Val Lys
    50                  55                  60

Gly Arg Phe Thr Ile Ser Arg Asp Asn Ser Lys Asn Thr Leu Tyr Leu
65                      70                  75                  80

Gln Met Asn Ser Leu Arg Ala Glu Asp Thr Ala Val Tyr Tyr Cys Ala
            85                  90                  95

Arg Asp Thr Tyr Leu His Phe Asp Tyr Trp Gly Gln Gly Thr Leu Val
            100                 105                 110

Thr Val Ser Ser
            115

<210>  77
<211>  116
<212>  PRT
<213>  Homo sapiens

<400>  77

Gln Val Gln Leu Val Glu Ser Gly Gly Gly Leu Val Gln Pro Gly Gly
1               5                   10                  15

Ser Leu Arg Leu Ser Cys Ala Ala Ser Gly Phe Thr Phe Arg Ser His
            20                  25                  30

Trp Leu Ser Trp Val Arg Gln Ala Pro Gly Lys Gly Leu Glu Trp Val
        35                  40                  45

Ser Val Ile Thr Pro Tyr Gly Asp Thr Tyr Tyr Ala Asp Ser Val Lys
    50                  55                  60

Gly Arg Phe Thr Ile Ser Arg Asp Asn Ser Lys Asn Thr Leu Tyr Leu
65                      70                  75                  80

Gln Met Asn Ser Leu Arg Ala Glu Asp Thr Ala Val Tyr Tyr Cys Ala
            85                  90                  95

Arg Asp Thr Tyr Leu His Phe Asp Tyr Trp Gly Gln Gly Thr Leu Val
```

Thr Val Ser Ser
            115

<210>   78
<211>   110
<212>   PRT
<213>   Homo sapiens

<400>   78

Asp Ile Glu Leu Thr Gln Pro Pro Ser Val Ser Val Ala Pro Gly Gln
1               5                   10                  15

Thr Ala Arg Ile Ser Cys Ser Gly Asp Asn Ile Gly Ser Phe Tyr Val
            20                  25                  30

His Trp Tyr Gln Gln Lys Pro Gly Gln Ala Pro Val Leu Val Ile Tyr
            35                  40                  45

Asp Asp Asn Asn Arg Pro Ser Gly Ile Pro Glu Arg Phe Ser Gly Ser
        50                  55                  60

Asn Ser Gly Asn Thr Ala Thr Leu Thr Ile Ser Gly Thr Gln Ala Glu
65                  70                  75                  80

Asp Glu Ala Asp Tyr Tyr Cys Gly Ser Trp Ala Gly Ser Ser Gly Ser
                85                  90                  95

Tyr Val Phe Gly Gly Arg Thr Lys Leu Thr Val Leu Gly Gln
                100                 105                 110

<210>   79
<211>   113
<212>   PRT
<213>   Homo sapiens

<400>   79

Asp Ile Ala Leu Thr Gln Pro Ala Ser Val Ser Gly Ser Pro Gly Gln
1               5                   10                  15

Ser Ile Thr Ile Ser Cys Thr Gly Thr Ser Ser Asp Val Gly Asp Ile
            20                  25                  30

Asn Asp Val Ser Trp Tyr Gln Gln His Pro Gly Lys Ala Pro Lys Leu
            35                  40                  45
```

FIGURE 9 Continued...

```
Met Ile Tyr Asp Val Asn Asn Arg Pro Ser Gly Val Ser Asn Arg Phe
    50                  55                  60

Ser Gly Ser Lys Ser Gly Asn Thr Ala Ser Leu Thr Ile Ser Gly Leu
65                  70                  75                  80

Gln Ala Glu Asp Glu Ala Asp Tyr Tyr Cys Ser Ser Tyr Gly Glu Ser
                85                  90                  95

Leu Thr Ser Tyr Val Phe Gly Gly Gly Thr Lys Leu Thr Val Leu Gly
                100                 105                 110

Gln

<210>  80
<211>  110
<212>  PRT
<213>  Homo sapiens

<400>  80

Asp Ile Glu Leu Thr Gln Pro Pro Ser Val Ser Val Ala Pro Gly Gln
1               5                   10                  15

Thr Ala Arg Ile Ser Cys Ser Gly Asp Asn Ile Gly Ser Phe Tyr Val
                20                  25                  30

His Trp Tyr Gln Gln Lys Pro Gly Gln Ala Pro Val Leu Val Ile Tyr
                35                  40                  45

Asp Asp Asn Asn Arg Pro Ser Gly Ile Pro Glu Arg Phe Ser Gly Ser
        50                  55                  60

Asn Ser Gly Asn Thr Ala Thr Leu Thr Ile Ser Gly Thr Gln Ala Glu
65                  70                  75                  80

Asp Glu Ala Asp Tyr Tyr Cys Ala Ser Trp Thr Gly Val Glu Pro Asp
                85                  90                  95

Tyr Val Phe Gly Gly Gly Thr Lys Leu Thr Val Leu Gly Gln
                100                 105                 110

<210>  81
<211>  113
<212>  PRT
<213>  Homo sapiens

```
Asp Ile Ala Leu Thr Gln Pro Ala Ser Val Ser Gly Ser Pro Gly Gln
1               5                   10                  15

Ser Ile Thr Ile Ser Cys Thr Gly Thr Ser Ser Asp Val Gly Asp Ile
                20                  25                  30

Asn Asp Val Ser Trp Tyr Gln Gln His Pro Gly Lys Ala Pro Lys Leu
            35                  40                  45

Met Ile Tyr Asp Val Asn Asn Arg Pro Ser Gly Val Ser Asn Arg Phe
        50                  55                  60

Ser Gly Ser Lys Ser Gly Asn Thr Ala Ser Leu Thr Ile Ser Gly Leu
65                  70                  75                  80

Gln Ala Glu Asp Glu Ala Asp Tyr Tyr Cys Gln Ser Tyr Ala Gly Ser
                85                  90                  95

Tyr Leu Ser Glu Val Phe Gly Gly Gly Thr Lys Leu Thr Val Leu Gly
                100                 105                 110

Gln

<210>  82
<211>  113
<212>  PRT
<213>  Homo sapiens

<400>  82

Asp Ile Ala Leu Thr Gln Pro Ala Ser Val Ser Gly Ser Pro Gly Gln
1               5                   10                  15

Ser Ile Thr Ile Ser Cys Thr Gly Thr Ser Ser Asp Val Gly Asp Ile
                20                  25                  30

Asn Asp Val Ser Trp Tyr Gln Gln His Pro Gly Lys Ala Pro Lys Leu
            35                  40                  45

Met Ile Tyr Asp Val Asn Asn Arg Pro Ser Gly Val Ser Asn Arg Phe
        50                  55                  60

Ser Gly Ser Lys Ser Gly Asn Thr Ala Ser Leu Thr Ile Ser Gly Leu
65                  70                  75                  80

Gln Ala Glu Asp Glu Ala Asp Tyr Tyr Cys Ser Ser Tyr Gly Glu Ser
```

Leu Thr Ser Tyr Val Phe Gly Gly Gly Thr Lys Leu Thr Val Leu Gly
            100                 105                 110

Gln

<210>  83
<211>  113
<212>  PRT
<213>  Homo sapiens

<400>  83

Asp Ile Ala Leu Thr Gln Pro Ala Ser Val Ser Gly Ser Pro Gly Gln
1               5                   10                  15

Ser Ile Thr Ile Ser Cys Thr Gly Thr Ser Ser Asp Val Gly Asp Ile
                20                  25                  30

Asn Asp Val Ser Trp Tyr Gln Gln His Pro Gly Lys Ala Pro Lys Leu
            35                  40                  45

Met Ile Tyr Asp Val Asn Asn Arg Pro Ser Gly Val Ser Asn Arg Phe
        50                  55                  60

Ser Gly Ser Lys Ser Gly Asn Thr Ala Ser Leu Thr Ile Ser Gly Leu
65                  70                  75                  80

Gln Ala Glu Asp Glu Ala Asp Tyr Tyr Cys Ser Ser Tyr Gly Glu Ser
                85                  90                  95

Leu Thr Ser Tyr Val Phe Gly Gly Gly Thr Lys Leu Thr Val Leu Gly
            100                 105                 110

Gln

<210>  84
<211>  113
<212>  PRT
<213>  Homo sapiens

<400>  84

Asp Ile Ala Leu Thr Gln Pro Ala Ser Val Ser Gly Ser Pro Gly Gln
1               5                   10                  15
```

FIGURE 9 Continued...

```
Ser Ile Thr Ile Ser Cys Thr Gly Thr Ser Ser Asp Val Gly Asp Ile
             20                  25                  30

Asn Asp Val Ser Trp Tyr Gln Gln His Pro Gly Lys Ala Pro Lys Leu
             35                  40                  45

Met Ile Tyr Asp Val Asn Asn Arg Pro Ser Gly Val Ser Asn Arg Phe
 50                      55                  60

Ser Gly Ser Lys Ser Gly Asn Thr Ala Ser Leu Thr Ile Ser Gly Leu
 65                  70                  75                  80

Gln Ala Glu Asp Glu Ala Asp Tyr Tyr Cys Ser Ser Tyr Gly Glu Ser
             85                  90                  95

Leu Thr Ser Tyr Val Phe Gly Gly Gly Thr Lys Leu Thr Val Leu Gly
             100                 105                 110

Gln

<210>  85
<211>  113
<212>  PRT
<213>  Homo sapiens

<400>  85

Asp Ile Ala Leu Thr Gln Pro Ala Ser Val Ser Gly Ser Pro Gly Gln
 1               5                  10                  15

Ser Ile Thr Ile Ser Cys Thr Gly Thr Ser Ser Asp Val Gly Asp Ile
             20                  25                  30

Asn Asp Val Ser Trp Tyr Gln Gln His Pro Gly Lys Ala Pro Lys Leu
             35                  40                  45

Met Ile Tyr Asp Val Asn Asn Arg Pro Ser Gly Val Ser Asn Arg Phe
 50                      55                  60

Ser Gly Ser Lys Ser Gly Asn Thr Ala Ser Leu Thr Ile Ser Gly Leu
 65                  70                  75                  80

Gln Ala Glu Asp Glu Ala Asp Tyr Tyr Cys Ser Ser Tyr Gly Glu Ser
             85                  90                  95

Leu Thr Ser Tyr Val Phe Gly Gly Gly Thr Lys Leu Thr Val Leu Gly
             100                 105                 110
```

FIGURE 9 Continued...

```
Gln

<210>  86
<211>  113
<212>  PRT
<213>  Homo sapiens

<400>  86

Asp Ile Ala Leu Thr Gln Pro Ala Ser Val Ser Gly Ser Pro Gly Gln
1               5                   10                  15

Ser Ile Thr Ile Ser Cys Thr Gly Thr Ser Ser Asp Val Gly Asp Ile
            20                  25                  30

Asn Asp Val Ser Trp Tyr Gln Gln His Pro Gly Lys Ala Pro Lys Leu
        35                  40                  45

Met Ile Tyr Asp Val Asn Asn Arg Pro Ser Gly Val Ser Asn Arg Phe
    50                  55                  60

Ser Gly Ser Lys Ser Gly Asn Thr Ala Ser Leu Thr Ile Ser Gly Leu
65                  70                  75                  80

Gln Ala Glu Asp Glu Ala Asp Tyr Tyr Cys Ser Thr Tyr Asp Gly Pro
                85                  90                  95

Gly Leu Ser Glu Val Phe Gly Gly Gly Thr Lys Leu Thr Val Leu Gly
            100                 105                 110

Gln

<210>  87
<211>  113
<212>  PRT
<213>  Homo sapiens

<400>  87

Asp Ile Ala Leu Thr Gln Pro Ala Ser Val Ser Gly Ser Pro Gly Gln
1               5                   10                  15

Ser Ile Thr Ile Ser Cys Thr Gly Thr Ser Ser Asp Val Gly Asp Ile
            20                  25                  30

Asn Asp Val Ser Trp Tyr Gln Gln His Pro Gly Lys Ala Pro Lys Leu
```

Met Ile Tyr Asp Val Asn Asn Arg Pro Ser Gly Val Ser Asn Arg Phe
            50                      55                  60

Ser Gly Ser Lys Ser Gly Asn Thr Ala Ser Leu Thr Ile Ser Gly Leu
    65                  70                      75                  80

Gln Ala Glu Asp Glu Ala Asp Tyr Tyr Cys Ser Ser Tyr Gly Glu Ser
                    85                      90                  95

Leu Thr Ser Tyr Val Phe Gly Gly Gly Thr Lys Leu Thr Val Leu Gly
                    100                     105                 110

Gln

<210> 88
<211> 113
<212> PRT
<213> Homo sapiens

<400> 88

Asp Ile Ala Leu Thr Gln Pro Ala Ser Val Ser Gly Ser Pro Gly Gln
1               5                       10                      15

Ser Ile Thr Ile Ser Cys Thr Gly Thr Ser Ser Asp Val Gly Asp Ile
                20                      25                      30

Asn Asp Val Ser Trp Tyr Gln Gln His Pro Gly Lys Ala Pro Lys Leu
                35                      40                      45

Met Ile Tyr Asp Val Asn Asn Arg Pro Ser Gly Val Ser Asn Arg Phe
            50                      55                  60

Ser Gly Ser Lys Ser Gly Asn Thr Ala Ser Leu Thr Ile Ser Gly Leu
65                  70                      75                  80

Gln Ala Glu Asp Glu Ala Asp Tyr Tyr Cys Ser Ser Tyr Thr Tyr Asp Gly Pro
                85                      90                  95

Gly Leu Ser Glu Val Phe Gly Gly Gly Thr Lys Leu Thr Val Leu Gly
                100                     105                 110

Gln
```

FIGURE 9 Continued...

```
<210>  89
<211>  372
<212>  DNA
<213>  Homo sapiens

<400>  89
caggtgcaat tggtggaaag cggcggcggc ctggtgcaac cgggcggcag cctgcgtctg      60
agctgcgcgg cctccggatt tacctttttct tcttatgtta tgaattgggt gcgccaagcc   120
cctgggaagg gtctcgagtg ggtgagcttt atctctggtg attctagcaa tacctattat   180
gcggatagcg tgaaaggccg ttttaccatt tcacgtgata attcgaaaaa caccctgtat   240
ctgcaaatga acagcctgcg tgcggaagat acggccgtgt attattgcgc gcgtactttt   300
atgcatggtc atcttggtgg tggtctttct atggattttt ggggccaagg caccctggtg   360
acggttagct ca                                                       372

<210>  90
<211>  351
<212>  DNA
<213>  Homo sapiens

<400>  90
caggtgcaat tggtggaaag cggcggcggc ctggtgcaac cgggcggcag cctgcgtctg      60
agctgcgcgg cctccggatt taccttttcgt tctcattggc tttcttgggt gcgccaagcc   120
cctgggaagg gtctcgagtg ggtgagcaat atcaattatg atggtagctc tacctattat   180
gcggatagcg tgaaaggccg ttttaccatt tcacgtgata attcgaaaaa caccctgtat   240
ctgcaaatga acagcctgcg tgcggaagat acggccgtgt attattgcgc gcgtgatact   300
tatcttcatt ttgattattg gggccaaggc accctggtga cggttagctc a              351

<210>  91
<211>  372
<212>  DNA
<213>  Homo sapiens

<400>  91
caggtgcaat tggtggaaag cggcggcggc ctggtgcaac cgggcggcag cctgcgtctg      60
agctgcgcgg cctccggatt tacctttttct tcttatgtta tgaattgggt gcgccaagcc   120
cctgggaagg gtctcgagtg ggtgagcttt atctctggtg attctagcaa tacctattat   180
gcggatagcg tgaaaggccg ttttaccatt tcacgtgata attcgaaaaa caccctgtat   240
ctgcaaatga acagcctgcg tgcggaagat acggccgtgt attattgcgc gcgtactttt   300
atgcatggtc atcttggtgg tggtctttct atggattttt ggggccaagg caccctggtg   360
acggttagct ca                                                       372
```

FIGURE 9 Continued...

```
<210>  92
<211>  351
<212>  DNA
<213>  Homo sapiens

<400>  92
caggtgcaat tggtggaaag cggcggcggc ctggtgcaac cgggcggcag cctgcgtctg      60
agctgcgcgg cctccggatt tacctttcgt tctcattggc tttcttgggt gcgccaagcc     120
cctgggaagg gtctcgagtg ggtgagcaat atcaattatg atggtagctc tacctattat     180
gcggatagcg tgaaaggccg ttttaccatt tcacgtgata attcgaaaaa caccctgtat     240
ctgcaaatga acagcctgcg tgcggaagat acggccgtgt attattgcgc gcgtgatact     300
tatcttcatt ttgattattg gggccaaggc accctggtga cggttagctc a              351

<210>  93
<211>  348
<212>  DNA
<213>  Homo sapiens

<400>  93
caggtgcaat tggtggaaag cggcggcggc ctggtgcaac cgggcggcag cctgcgtctg      60
agctgcgcgg cctccggatt tacctttcgt tctcattggc tttcttgggt gcgccaagcc     120
cctgggaagg gtctcgagtg ggtgagcgtt actggtgttc atggtgatac ttattatgct     180
gattctgtta agggtcgttt taccatttca cgtgataatt cgaaaaacac cctgtatctg     240
caaatgaaca gcctgcgtgc ggaagatacg gccgtgtatt attgcgcgcg tgatacttat     300
cttcattttg attattgggg ccaaggcacc ctggtgacgg ttagctca                  348

<210>  94
<211>  348
<212>  DNA
<213>  Homo sapiens

<400>  94
caggtgcaat tggtggaaag cggcggcggc ctggtgcaac cgggcggcag cctgcgtctg      60
agctgcgcgg cctccggatt tacctttcgt tctcattggc tttcttgggt gcgccaagcc     120
cctgggaagg gtctcgagtg ggtgagcgtt attggtaatt ggggtgatac ttattatgct     180
gattctgtta agggtcgttt taccatttca cgtgataatt cgaaaaacac cctgtatctg     240
caaatgaaca gcctgcgtgc ggaagatacg gccgtgtatt attgcgcgcg tgatacttat     300
cttcattttg attattgggg ccaaggcacc ctggtgacgg ttagctca                  348

<210>  95
<211>  348
<212>  DNA
```

FIGURE 9 Continued...

```
<213>  Homo sapiens

<400>  95
caggtgcaat tggtggaaag cggcggcggc ctggtgcaac cgggcggcag cctgcgtctg        60
agctgcgcgg cctccggatt tacctttcgt tctcattggc tttcttgggt gcgccaagcc       120
cctgggaagg gtctcgagtg ggtgagcgtt actactcatc agggttatac ttattatgct       180
gattctgtta agggtcgttt taccatttca cgtgataatt cgaaaaacac cctgtatctg       240
caaatgaaca gcctgcgtgc ggaagatacg gccgtgtatt attgcgcgcg tgatacttat       300
cttcattttg attattgggg ccaaggcacc ctggtgacgg ttagctca                   348

<210>  96
<211>  348
<212>  DNA
<213>  Homo sapiens

<400>  96
caggtgcaat tggtggaaag cggcggcggc ctggtgcaac cgggcggcag cctgcgtctg        60
agctgcgcgg cctccggatt tacctttcgt tctcattggc tttcttgggt gcgccaagcc       120
cctgggaagg gtctcgagtg ggtgagcgct actaatcgtt atggttatac ttattatgct       180
gattctgtta agggtcgttt taccatttca cgtgataatt cgaaaaacac cctgtatctg       240
caaatgaaca gcctgcgtgc ggaagatacg gccgtgtatt attgcgcgcg tgatacttat       300
cttcattttg attattgggg ccaaggcacc ctggtgacgg ttagctca                   348

<210>  97
<211>  351
<212>  DNA
<213>  Homo sapiens

<400>  97
caggtgcaat tggtggaaag cggcggcggc ctggtgcaac cgggcggcag cctgcgtctg        60
agctgcgcgg cctccggatt tacctttcgt tctcattggc tttcttgggt gcgccaagcc       120
cctgggaagg gtctcgagtg ggtgagcaat atcaattatg atggtagctc tacctattat       180
gcggatagcg tgaaaggccg ttttaccatt tcacgtgata attcgaaaaa caccctgtat       240
ctgcaaatga acagcctgcg tgcggaagat acggccgtgt attattgcgc gcgtgatact       300
tatcttcatt ttgattattg gggccaaggc accctggtga cggttagctc a               351

<210>  98
<211>  348
<212>  DNA
<213>  Homo sapiens

<400>  98
caggtgcaat tggtggaaag cggcggcggc ctggtgcaac cgggcggcag cctgcgtctg        60
```

FIGURE 9 Continued...

```
agctgcgcgg cctccggatt tacctttcgt tctcattggc tttcttgggt gcgccaagcc      120
cctgggaagg gtctcgagtg ggtgagcgtt attactcctt atggtgatac ttattatgct      180
gattctgtta agggtcgttt taccatttca cgtgataatt cgaaaaacac cctgtatctg      240
caaatgaaca gcctgcgtgc ggaagatacg gccgtgtatt attgcgcgcg tgatacttat      300
cttcattttg attattgggg ccaaggcacc ctggtgacgg ttagctca                   348

<210>   99
<211>   348
<212>   DNA
<213>   Homo sapiens

<400>   99
caggtgcaat tggtggaaag cggcggcggc ctggtgcaac cgggcggcag cctgcgtctg       60
agctgcgcgg cctccggatt tacctttcgt tctcattggc tttcttgggt gcgccaagcc      120
cctgggaagg gtctcgagtg ggtgagcgtt attactcctt atggtgatac ttattatgct      180
gattctgtta agggtcgttt taccatttca cgtgataatt cgaaaaacac cctgtatctg      240
caaatgaaca gcctgcgtgc ggaagatacg gccgtgtatt attgcgcgcg tgatacttat      300
cttcattttg attattgggg ccaaggcacc ctggtgacgg ttagctca                   348

<210>   100
<211>   330
<212>   DNA
<213>   Homo sapiens

<400>   100
gatatcgaac tgacccagcc gccttcagtg agcgttgcac caggtcagac cgcgcgtatc       60
tcgtgtagcg gcgataatat tggttctttt tatgttcatt ggtaccagca gaaacccggg      120
caggcgccag ttcttgtgat ttatgatgat aataatcgtc cctcaggcat cccggaacgc      180
tttagcggat ccaacagcgg caacaccgcg accctgacca ttagcggcac tcaggcggaa      240
gacgaagcgg attattattg cggttcttgg gctggttctt ctggttctta tgtgtttggc      300
ggccgcacga agttaaccgt tcttggccag                                       330

<210>   101
<211>   339
<212>   DNA
<213>   Homo sapiens

<400>   101
gatatcgcac tgacccagcc agcttcagtg agcggctcac caggtcagag cattaccatc       60
tcgtgtacgg gtactagcag cgatgttggt gatattaatg atgtgtcttg gtaccagcag      120
catcccggga aggcgccgaa acttatgatt tatgatgtta ataatcgtcc ctcaggcgtg      180
```

FIGURE 9 Continued...

```
agcaaccgtt ttagcggatc caaaagcggc aacaccgcga gcctgaccat tagcggcctg      240
caagcggaag acgaagcgga ttattattgc tcttcttatg gtgagtctct tacttcttat      300
gtgtttggcg gcggcacgaa gttaaccgtt cttggccag                             339

<210>   102
<211>   330
<212>   DNA
<213>   Homo sapiens

<400>   102
gatatcgaac tgacccagcc gccttcagtg agcgttgcac caggtcagac cgcgcgtatc       60
tcgtgtagcg gcgataatat tggttctttt tatgttcatt ggtaccagca gaaacccggg      120
caggcgccag ttcttgtgat ttatgatgat aataatcgtc cctcaggcat cccggaacgc      180
tttagcggat ccaacagcgg caacaccgcg accctgacca ttagcggcac tcaggcggaa      240
gacgaagcgg attattattg cgcttcttgg actggtgttg agcctgatta tgtgtttggc      300
ggcggcacga agttaaccgt tcttggccag                                       330

<210>   103
<211>   339
<212>   DNA
<213>   Homo sapiens

<400>   103
gatatcgcac tgacccagcc agcttcagtg agcggctcac caggtcagag cattaccatc       60
tcgtgtacgg gtactagcag cgatgttggt gatattaatg atgtgtcttg gtaccagcag      120
catcccggga aggcgccgaa acttatgatt tatgatgtta ataatcgtcc ctcaggcgtg      180
agcaaccgtt ttagcggatc caaaagcggc aacaccgcga gcctgaccat tagcggcctg      240
caagcggaag acgaagcgga ttattattgc cagtcttatg ctggttctta tctttctgag      300
gtgtttggcg gcggcacgaa gttaaccgtt cttggccag                             339

<210>   104
<211>   339
<212>   DNA
<213>   Homo sapiens

<400>   104
gatatcgcac tgacccagcc agcttcagtg agcggctcac caggtcagag cattaccatc       60
tcgtgtacgg gtactagcag cgatgttggt gatattaatg atgtgtcttg gtaccagcag      120
catcccggga aggcgccgaa acttatgatt tatgatgtta ataatcgtcc ctcaggcgtg      180
agcaaccgtt ttagcggatc caaaagcggc aacaccgcga gcctgaccat tagcggcctg      240
caagcggaag acgaagcgga ttattattgc tcttcttatg gtgagtctct tacttcttat      300
```

FIGURE 9 Continued...

```
gtgtttggcg gcggcacgaa gttaaccgtt cttggccag                    339

<210>  105
<211>  339
<212>  DNA
<213>  Homo sapiens

<400>  105
gatatcgcac tgacccagcc agcttcagtg agcggctcac caggtcagag cattaccatc    60
tcgtgtacgg gtactagcag cgatgttggt gatattaatg atgtgtcttg gtaccagcag   120
catcccggga aggcgccgaa acttatgatt tatgatgtta ataatcgtcc ctcaggcgtg   180
agcaaccgtt ttagcggatc caaaagcggc aacaccgcga gcctgaccat tagcggcctg   240
caagcggaag acgaagcgga ttattattgc tcttcttatg gtgagtctct tacttcttat   300
gtgtttggcg gcggcacgaa gttaaccgtt cttggccag                    339

<210>  106
<211>  339
<212>  DNA
<213>  Homo sapiens

<400>  106
gatatcgcac tgacccagcc agcttcagtg agcggctcac caggtcagag cattaccatc    60
tcgtgtacgg gtactagcag cgatgttggt gatattaatg atgtgtcttg gtaccagcag   120
catcccggga aggcgccgaa acttatgatt tatgatgtta ataatcgtcc ctcaggcgtg   180
agcaaccgtt ttagcggatc caaaagcggc aacaccgcga gcctgaccat tagcggcctg   240
caagcggaag acgaagcgga ttattattgc tcttcttatg gtgagtctct tacttcttat   300
gtgtttggcg gcggcacgaa gttaaccgtt cttggccag                    339

<210>  107
<211>  339
<212>  DNA
<213>  Homo sapiens

<400>  107
gatatcgcac tgacccagcc agcttcagtg agcggctcac caggtcagag cattaccatc    60
tcgtgtacgg gtactagcag cgatgttggt gatattaatg atgtgtcttg gtaccagcag   120
catcccggga aggcgccgaa acttatgatt tatgatgtta ataatcgtcc ctcaggcgtg   180
agcaaccgtt ttagcggatc caaaagcggc aacaccgcga gcctgaccat tagcggcctg   240
caagcggaag acgaagcgga ttattattgc tcttcttatg gtgagtctct tacttcttat   300
gtgtttggcg gcggcacgaa gttaaccgtt cttggccag                    339
```

FIGURE 9 Continued...

```
<210>  108
<211>  339
<212>  DNA
<213>  Homo sapiens

<400>  108
gatatcgcac tgacccagcc agcttcagtg agcggctcac caggtcagag cattaccatc    60
tcgtgtacgg gtactagcag cgatgttggt gatattaatg atgtgtcttg gtaccagcag   120
catcccggga aggcgccgaa acttatgatt tatgatgtta ataatcgtcc ctcaggcgtg   180
agcaaccgtt ttagcggatc caaaagcggc aacaccgcga gcctgaccat tagcggcctg   240
caagcggaag acgaagcgga ttattattgc tctacttatg atggtcctgg tctttctgag   300
gtgtttggcg gcggcacgaa gttaaccgtt cttggccag                          339

<210>  109
<211>  339
<212>  DNA
<213>  Homo sapiens

<400>  109
gatatcgcac tgacccagcc agcttcagtg agcggctcac caggtcagag cattaccatc    60
tcgtgtacgg gtactagcag cgatgttggt gatattaatg atgtgtcttg gtaccagcag   120
catcccggga aggcgccgaa acttatgatt tatgatgtta ataatcgtcc ctcaggcgtg   180
agcaaccgtt ttagcggatc caaaagcggc aacaccgcga gcctgaccat tagcggcctg   240
caagcggaag acgaagcgga ttattattgc tcttcttatg gtgagtctct tacttcttat   300
gtgtttggcg gcggcacgaa gttaaccgtt cttggccag                          339

<210>  110
<211>  339
<212>  DNA
<213>  Homo sapiens

<400>  110
gatatcgcac tgacccagcc agcttcagtg agcggctcac caggtcagag cattaccatc    60
tcgtgtacgg gtactagcag cgatgttggt gatattaatg atgtgtcttg gtaccagcag   120
catcccggga aggcgccgaa acttatgatt tatgatgtta ataatcgtcc ctcaggcgtg   180
agcaaccgtt ttagcggatc caaaagcggc aacaccgcga gcctgaccat tagcggcctg   240
caagcggaag acgaagcgga ttattattgc tctacttatg atggtcctgg tctttctgag   300
gtgtttggcg gcggcacgaa gttaaccgtt cttggccag                          339

<210>  111
<211>  469
<212>  PRT
<213>  Homo sapiens
```

Met Ala Trp Val Trp Thr Leu Pro Phe Leu Met Ala Ala Ala Gln Ser
1               5                   10                  15

Val Gln Ala Gln Val Gln Leu Val Glu Ser Gly Gly Gly Leu Val Gln
            20                  25                  30

Pro Gly Gly Ser Leu Arg Leu Ser Cys Ala Ala Ser Gly Phe Thr Phe
            35                  40                  45

Ser Ser Tyr Val Met Asn Trp Val Arg Gln Ala Pro Gly Lys Gly Leu
            50                  55                  60

Glu Trp Val Ser Phe Ile Ser Gly Asp Ser Ser Asn Thr Tyr Tyr Ala
65                  70                  75                  80

Asp Ser Val Lys Gly Arg Phe Thr Ile Ser Arg Asp Asn Ser Lys Asn
            85                  90                  95

Thr Leu Tyr Leu Gln Met Asn Ser Leu Arg Ala Glu Asp Thr Ala Val
            100                 105                 110

Tyr Tyr Cys Ala Arg Thr Phe Met His Gly His Leu Gly Gly Gly Leu
            115                 120                 125

Ser Met Asp Phe Trp Gly Gln Gly Thr Leu Val Thr Val Ser Ser Ala
            130                 135                 140

Ser Thr Lys Gly Pro Ser Val Phe Pro Leu Ala Pro Cys Ser Arg Ser
145                 150                 155                 160

Thr Ser Glu Ser Thr Ala Ala Leu Gly Cys Leu Val Lys Asp Tyr Phe
            165                 170                 175

Pro Glu Pro Val Thr Val Ser Trp Asn Ser Gly Ala Leu Thr Ser Gly
            180                 185                 190

Val His Thr Phe Pro Ala Val Leu Gln Ser Ser Gly Leu Tyr Ser Leu
            195                 200                 205

Ser Ser Val Val Thr Val Pro Ser Ser Asn Phe Gly Thr Gln Thr Tyr
            210                 215                 220

Thr Cys Asn Val Asp His Lys Pro Ser Asn Thr Lys Val Asp Lys Thr
225                 230                 235                 240
```

FIGURE 9 Continued...

```
Val Glu Arg Lys Cys Cys Val Glu Cys Pro Pro Cys Pro Ala Pro Pro
            245                 250                 255

Val Ala Gly Pro Ser Val Phe Leu Phe Pro Pro Lys Pro Lys Asp Thr
            260                 265                 270

Leu Met Ile Ser Arg Thr Pro Glu Val Thr Cys Val Val Val Asp Val
        275                 280                 285

Ser His Glu Asp Pro Glu Val Gln Phe Asn Trp Tyr Val Asp Gly Val
    290                 295                 300

Glu Val His Asn Ala Lys Thr Lys Pro Arg Glu Glu Gln Phe Asn Ser
305                 310                 315                 320

Thr Phe Arg Val Val Ser Val Leu Thr Val Val His Gln Asp Trp Leu
            325                 330                 335

Asn Gly Lys Glu Tyr Lys Cys Lys Val Ser Asn Lys Gly Leu Pro Ala
            340                 345                 350

Pro Ile Glu Lys Thr Ile Ser Lys Thr Lys Gly Gln Pro Arg Glu Pro
            355                 360                 365

Gln Val Tyr Thr Leu Pro Pro Ser Arg Glu Glu Met Thr Lys Asn Gln
    370                 375                 380

Val Ser Leu Thr Cys Leu Val Lys Gly Phe Tyr Pro Ser Asp Ile Ala
385                 390                 395                 400

Val Glu Trp Glu Ser Asn Gly Gln Pro Glu Asn Asn Tyr Lys Thr Thr
            405                 410                 415

Pro Pro Met Leu Asp Ser Asp Gly Ser Phe Phe Leu Tyr Ser Lys Leu
            420                 425                 430

Thr Val Asp Lys Ser Arg Trp Gln Gln Gly Asn Val Phe Ser Cys Ser
        435                 440                 445

Val Met His Glu Ala Leu His Asn His Tyr Thr Gln Lys Ser Leu Ser
    450                 455                 460

Leu Ser Pro Gly Lys
465
```

FIGURE 9 Continued...

```
<210>  112
<211>  462
<212>  PRT
<213>  Homo sapiens

<400>  112
```

| | | | | | | | | | | | | | | |
|---|---|---|---|---|---|---|---|---|---|---|---|---|---|---|
| Met | Ala | Trp | Val | Trp | Thr | Leu | Pro | Phe | Leu | Met | Ala | Ala | Gln | Ser |
| 1 | | | | 5 | | | | | 10 | | | | | 15 |
| Val | Gln | Ala | Gln | Val | Gln | Leu | Val | Glu | Ser | Gly | Gly | Gly | Leu | Val | Gln |
| | | | 20 | | | | | 25 | | | | | 30 | | |
| Pro | Gly | Gly | Ser | Leu | Arg | Leu | Ser | Cys | Ala | Ala | Ser | Gly | Phe | Thr | Phe |
| | | | 35 | | | | | 40 | | | | | 45 | | |
| Arg | Ser | His | Trp | Leu | Ser | Trp | Val | Arg | Gln | Ala | Pro | Gly | Lys | Gly | Leu |
| | 50 | | | | | 55 | | | | | | 60 | | | |
| Glu | Trp | Val | Ser | Asn | Ile | Asn | Tyr | Asp | Gly | Ser | Ser | Thr | Tyr | Tyr | Ala |
| 65 | | | | | 70 | | | | | 75 | | | | | 80 |
| Asp | Ser | Val | Lys | Gly | Arg | Phe | Thr | Ile | Ser | Arg | Asp | Asn | Ser | Lys | Asn |
| | | | | 85 | | | | | 90 | | | | | 95 | |
| Thr | Leu | Tyr | Leu | Gln | Met | Asn | Ser | Leu | Arg | Ala | Glu | Asp | Thr | Ala | Val |
| | | | | 100 | | | | | 105 | | | | | 110 | |
| Tyr | Tyr | Cys | Ala | Arg | Asp | Thr | Tyr | Leu | His | Phe | Asp | Tyr | Trp | Gly | Gln |
| | | | 115 | | | | | 120 | | | | | 125 | | |
| Gly | Thr | Leu | Val | Thr | Val | Ser | Ser | Ala | Ser | Thr | Lys | Gly | Pro | Ser | Val |
| | | 130 | | | | | 135 | | | | | 140 | | | |
| Phe | Pro | Leu | Ala | Pro | Cys | Ser | Arg | Ser | Thr | Ser | Glu | Ser | Thr | Ala | Ala |
| 145 | | | | | 150 | | | | | 155 | | | | | 160 |
| Leu | Gly | Cys | Leu | Val | Lys | Asp | Tyr | Phe | Pro | Glu | Pro | Val | Thr | Val | Ser |
| | | | | 165 | | | | | 170 | | | | | 175 | |
| Trp | Asn | Ser | Gly | Ala | Leu | Thr | Ser | Gly | Val | His | Thr | Phe | Pro | Ala | Val |
| | | | 180 | | | | | 185 | | | | | 190 | | |
| Leu | Gln | Ser | Ser | Gly | Leu | Tyr | Ser | Leu | Ser | Ser | Val | Val | Thr | Val | Pro |
| | | | 195 | | | | | 200 | | | | | 205 | | |
| Ser | Ser | Asn | Phe | Gly | Thr | Gln | Thr | Tyr | Thr | Cys | Asn | Val | Asp | His | Lys |

Pro  Ser  Asn  Thr  Lys  Val  Asp  Lys  Thr  Val  Glu  Arg  Lys  Cys  Cys  Val
225                 230                 235                           240

Glu  Cys  Pro  Pro  Cys  Pro  Ala  Pro  Pro  Val  Ala  Gly  Pro  Ser  Val  Phe
               245                      250                      255

Leu  Phe  Pro  Pro  Lys  Pro  Lys  Asp  Thr  Leu  Met  Ile  Ser  Arg  Thr  Pro
               260                      265                 270

Glu  Val  Thr  Cys  Val  Val  Val  Asp  Val  Ser  His  Glu  Asp  Pro  Glu  Val
          275                      280                      285

Gln  Phe  Asn  Trp  Tyr  Val  Asp  Gly  Val  Glu  Val  His  Asn  Ala  Lys  Thr
     290                      295                      300

Lys  Pro  Arg  Glu  Glu  Gln  Phe  Asn  Ser  Thr  Phe  Arg  Val  Val  Ser  Val
305                 310                      315                           320

Leu  Thr  Val  Val  His  Gln  Asp  Trp  Leu  Asn  Gly  Lys  Glu  Tyr  Lys  Cys
               325                      330                      335

Lys  Val  Ser  Asn  Lys  Gly  Leu  Pro  Ala  Pro  Ile  Glu  Lys  Thr  Ile  Ser
               340                      345                      350

Lys  Thr  Lys  Gly  Gln  Pro  Arg  Glu  Pro  Gln  Val  Tyr  Thr  Leu  Pro  Pro
               355                      360                      365

Ser  Arg  Glu  Glu  Met  Thr  Lys  Asn  Gln  Val  Ser  Leu  Thr  Cys  Leu  Val
     370                      375                      380

Lys  Gly  Phe  Tyr  Pro  Ser  Asp  Ile  Ala  Val  Glu  Trp  Glu  Ser  Asn  Gly
385                      390                      395                      400

Gln  Pro  Glu  Asn  Asn  Tyr  Lys  Thr  Thr  Pro  Pro  Met  Leu  Asp  Ser  Asp
               405                      410                      415

Gly  Ser  Phe  Phe  Leu  Tyr  Ser  Lys  Leu  Thr  Val  Asp  Lys  Ser  Arg  Trp
               420                      425                      430

Gln  Gln  Gly  Asn  Val  Phe  Ser  Cys  Ser  Val  Met  His  Glu  Ala  Leu  His
               435                      440                      445

Asn  His  Tyr  Thr  Gln  Lys  Ser  Leu  Ser  Leu  Ser  Pro  Gly  Lys
450                      455                      460
```

FIGURE 9 Continued...

```
<210>  113
<211>  469
<212>  PRT
<213>  Homo sapiens

<400>  113
```

| Met | Ala | Trp | Val | Trp | Thr | Leu | Pro | Phe | Leu | Met | Ala | Ala | Ala | Gln | Ser |
|-----|-----|-----|-----|-----|-----|-----|-----|-----|-----|-----|-----|-----|-----|-----|-----|
| 1   |     |     |     | 5   |     |     |     |     | 10  |     |     |     |     | 15  |     |

| Val | Gln | Ala | Gln | Val | Gln | Leu | Val | Glu | Ser | Gly | Gly | Gly | Leu | Val | Gln |
|     |     |     | 20  |     |     |     |     | 25  |     |     |     |     | 30  |     |     |

| Pro | Gly | Gly | Ser | Leu | Arg | Leu | Ser | Cys | Ala | Ala | Ser | Gly | Phe | Thr | Phe |
|     |     | 35  |     |     |     |     | 40  |     |     |     |     | 45  |     |     |     |

| Ser | Ser | Tyr | Val | Met | Asn | Trp | Val | Arg | Gln | Ala | Pro | Gly | Lys | Gly | Leu |
|     | 50  |     |     |     |     | 55  |     |     |     |     | 60  |     |     |     |     |

| Glu | Trp | Val | Ser | Phe | Ile | Ser | Gly | Asp | Ser | Ser | Asn | Thr | Tyr | Tyr | Ala |
| 65  |     |     |     |     | 70  |     |     |     |     | 75  |     |     |     |     | 80  |

| Asp | Ser | Val | Lys | Gly | Arg | Phe | Thr | Ile | Ser | Arg | Asp | Asn | Ser | Lys | Asn |
|     |     |     |     | 85  |     |     |     |     | 90  |     |     |     |     | 95  |     |

| Thr | Leu | Tyr | Leu | Gln | Met | Asn | Ser | Leu | Arg | Ala | Glu | Asp | Thr | Ala | Val |
|     |     |     | 100 |     |     |     |     | 105 |     |     |     |     | 110 |     |     |

| Tyr | Tyr | Cys | Ala | Arg | Thr | Phe | Met | His | Gly | His | Leu | Gly | Gly | Gly | Leu |
|     |     | 115 |     |     |     |     | 120 |     |     |     |     | 125 |     |     |     |

| Ser | Met | Asp | Phe | Trp | Gly | Gln | Gly | Thr | Leu | Val | Thr | Val | Ser | Ser | Ala |
|     | 130 |     |     |     |     | 135 |     |     |     |     | 140 |     |     |     |     |

| Ser | Thr | Lys | Gly | Pro | Ser | Val | Phe | Pro | Leu | Ala | Pro | Cys | Ser | Arg | Ser |
| 145 |     |     |     |     | 150 |     |     |     |     | 155 |     |     |     |     | 160 |

| Thr | Ser | Glu | Ser | Thr | Ala | Ala | Leu | Gly | Cys | Leu | Val | Lys | Asp | Tyr | Phe |
|     |     |     |     | 165 |     |     |     |     | 170 |     |     |     |     | 175 |     |

| Pro | Glu | Pro | Val | Thr | Val | Ser | Trp | Asn | Ser | Gly | Ala | Leu | Thr | Ser | Gly |
|     |     |     | 180 |     |     |     |     | 185 |     |     |     |     | 190 |     |     |

| Val | His | Thr | Phe | Pro | Ala | Val | Leu | Gln | Ser | Ser | Gly | Leu | Tyr | Ser | Leu |
|     |     | 195 |     |     |     |     | 200 |     |     |     |     | 205 |     |     |     |

FIGURE 9 Continued...

```
Ser Ser Val Val Thr Val Pro Ser Ser Asn Phe Gly Thr Gln Thr Tyr
    210             215                 220

Thr Cys Asn Val Asp His Lys Pro Ser Asn Thr Lys Val Asp Lys Thr
225             230                 235                 240

Val Glu Arg Lys Cys Cys Val Glu Cys Pro Pro Cys Pro Ala Pro Pro
                245                 250                 255

Val Ala Gly Pro Ser Val Phe Leu Phe Pro Pro Lys Pro Lys Asp Thr
            260                 265                 270

Leu Met Ile Ser Arg Thr Pro Glu Val Thr Cys Val Val Val Asp Val
            275                 280                 285

Ser His Glu Asp Pro Glu Val Gln Phe Asn Trp Tyr Val Asp Gly Val
    290                 295                 300

Glu Val His Asn Ala Lys Thr Lys Pro Arg Glu Glu Gln Phe Asn Ser
305                 310                 315                 320

Thr Phe Arg Val Val Ser Val Leu Thr Val Val His Gln Asp Trp Leu
                325                 330                 335

Asn Gly Lys Glu Tyr Lys Cys Lys Val Ser Asn Lys Gly Leu Pro Ala
            340                 345                 350

Pro Ile Glu Lys Thr Ile Ser Lys Thr Lys Gly Gln Pro Arg Glu Pro
            355                 360                 365

Gln Val Tyr Thr Leu Pro Pro Ser Arg Glu Glu Met Thr Lys Asn Gln
    370                 375                 380

Val Ser Leu Thr Cys Leu Val Lys Gly Phe Tyr Pro Ser Asp Ile Ala
385                 390                 395                 400

Val Glu Trp Glu Ser Asn Gly Gln Pro Glu Asn Asn Tyr Lys Thr Thr
                405                 410                 415

Pro Pro Met Leu Asp Ser Asp Gly Ser Phe Phe Leu Tyr Ser Lys Leu
            420                 425                 430

Thr Val Asp Lys Ser Arg Trp Gln Gln Gly Asn Val Phe Ser Cys Ser
            435                 440                 445

Val Met His Glu Ala Leu His Asn His Tyr Thr Gln Lys Ser Leu Ser
```

Leu Ser Pro Gly Lys
465

<210>  114
<211>  462
<212>  PRT
<213>  Homo sapiens

<400>  114

Met Ala Trp Val Trp Thr Leu Pro Phe Leu Met Ala Ala Ala Gln Ser
1               5                   10                  15

Val Gln Ala Gln Val Gln Leu Val Glu Ser Gly Gly Gly Leu Val Gln
            20                  25                  30

Pro Gly Gly Ser Leu Arg Leu Ser Cys Ala Ala Ser Gly Phe Thr Phe
        35                  40                  45

Arg Ser His Trp Leu Ser Trp Val Arg Gln Ala Pro Gly Lys Gly Leu
    50                  55                  60

Glu Trp Val Ser Asn Ile Asn Tyr Asp Gly Ser Ser Thr Tyr Tyr Ala
65                  70                  75                  80

Asp Ser Val Lys Gly Arg Phe Thr Ile Ser Arg Asp Asn Ser Lys Asn
                85                  90                  95

Thr Leu Tyr Leu Gln Met Asn Ser Leu Arg Ala Glu Asp Thr Ala Val
            100                 105                 110

Tyr Tyr Cys Ala Arg Asp Thr Tyr Leu His Phe Asp Tyr Trp Gly Gln
        115                 120                 125

Gly Thr Leu Val Thr Val Ser Ser Ala Ser Thr Lys Gly Pro Ser Val
    130                 135                 140

Phe Pro Leu Ala Pro Cys Ser Arg Ser Thr Ser Glu Ser Thr Ala Ala
145                 150                 155                 160

Leu Gly Cys Leu Val Lys Asp Tyr Phe Pro Glu Pro Val Thr Val Ser
                165                 170                 175

Trp Asn Ser Gly Ala Leu Thr Ser Gly Val His Thr Phe Pro Ala Val
            180                 185                 190
```

FIGURE 9 Continued…

```
Leu Gln Ser Ser Gly Leu Tyr Ser Leu Ser Ser Val Val Thr Val Pro
        195             200             205
Ser Ser Asn Phe Gly Thr Gln Thr Tyr Thr Cys Asn Val Asp His Lys
        210             215             220
Pro Ser Asn Thr Lys Val Asp Lys Thr Val Glu Arg Lys Cys Cys Val
225             230             235             240
Glu Cys Pro Pro Cys Pro Ala Pro Pro Val Ala Gly Pro Ser Val Phe
            245             250             255
Leu Phe Pro Pro Lys Pro Lys Asp Thr Leu Met Ile Ser Arg Thr Pro
            260             265             270
Glu Val Thr Cys Val Val Val Asp Val Ser His Glu Asp Pro Glu Val
        275             280             285
Gln Phe Asn Trp Tyr Val Asp Gly Val Glu Val His Asn Ala Lys Thr
    290             295             300
Lys Pro Arg Glu Glu Gln Phe Asn Ser Thr Phe Arg Val Val Ser Val
305             310             315             320
Leu Thr Val Val His Gln Asp Trp Leu Asn Gly Lys Glu Tyr Lys Cys
            325             330             335
Lys Val Ser Asn Lys Gly Leu Pro Ala Pro Ile Glu Lys Thr Ile Ser
            340             345             350
Lys Thr Lys Gly Gln Pro Arg Glu Pro Gln Val Tyr Thr Leu Pro Pro
        355             360             365
Ser Arg Glu Glu Met Thr Lys Asn Gln Val Ser Leu Thr Cys Leu Val
    370             375             380
Lys Gly Phe Tyr Pro Ser Asp Ile Ala Val Glu Trp Glu Ser Asn Gly
385             390             395             400
Gln Pro Glu Asn Asn Tyr Lys Thr Thr Pro Pro Met Leu Asp Ser Asp
            405             410             415
Gly Ser Phe Phe Leu Tyr Ser Lys Leu Thr Val Asp Lys Ser Arg Trp
            420             425             430
```

FIGURE 9 Continued...

```
Gln Gln Gly Asn Val Phe Ser Cys Ser Val Met His Glu Ala Leu His
        435                 440                 445

Asn His Tyr Thr Gln Lys Ser Leu Ser Leu Ser Pro Gly Lys
    450                 455                 460

<210> 115
<211> 461
<212> PRT
<213> Homo sapiens

<400> 115

Met Ala Trp Val Trp Thr Leu Pro Phe Leu Met Ala Ala Ala Gln Ser
1               5                   10                  15

Val Gln Ala Gln Val Gln Leu Val Glu Ser Gly Gly Gly Leu Val Gln
            20                  25                  30

Pro Gly Gly Ser Leu Arg Leu Ser Cys Ala Ala Ser Gly Phe Thr Phe
        35                  40                  45

Arg Ser His Trp Leu Ser Trp Val Arg Gln Ala Pro Gly Lys Gly Leu
    50                  55                  60

Glu Trp Val Ser Val Thr Gly Val His Gly Asp Thr Tyr Tyr Ala Asp
65                  70                  75                  80

Ser Val Lys Gly Arg Phe Thr Ile Ser Arg Asp Asn Ser Lys Asn Thr
                85                  90                  95

Leu Tyr Leu Gln Met Asn Ser Leu Arg Ala Glu Asp Thr Ala Val Tyr
            100                 105                 110

Tyr Cys Ala Arg Asp Thr Tyr Leu His Phe Asp Tyr Trp Gly Gln Gly
        115                 120                 125

Thr Leu Val Thr Val Ser Ser Ala Ser Thr Lys Gly Pro Ser Val Phe
    130                 135                 140

Pro Leu Ala Pro Cys Ser Arg Ser Thr Ser Glu Ser Thr Ala Ala Leu
145                 150                 155                 160

Gly Cys Leu Val Lys Asp Tyr Phe Pro Glu Pro Val Thr Val Ser Trp
                165                 170                 175

Asn Ser Gly Ala Leu Thr Ser Gly Val His Thr Phe Pro Ala Val Leu
            180                 185                 190
```

FIGURE 9 Continued...

```
Gln Ser Ser Gly Leu Tyr Ser Leu Ser Ser Val Val Thr Val Pro Ser
        195                 200                 205

Ser Asn Phe Gly Thr Gln Thr Tyr Thr Cys Asn Val Asp His Lys Pro
        210                 215                 220

Ser Asn Thr Lys Val Asp Lys Thr Val Glu Arg Lys Cys Cys Val Glu
225                 230                 235                 240

Cys Pro Pro Cys Pro Ala Pro Pro Val Ala Gly Pro Ser Val Phe Leu
                245                 250                 255

Phe Pro Pro Lys Pro Lys Asp Thr Leu Met Ile Ser Arg Thr Pro Glu
                260                 265                 270

Val Thr Cys Val Val Val Asp Val Ser His Glu Asp Pro Glu Val Gln
            275                 280                 285

Phe Asn Trp Tyr Val Asp Gly Val Glu Val His Asn Ala Lys Thr Lys
        290                 295                 300

Pro Arg Glu Glu Gln Phe Asn Ser Thr Phe Arg Val Val Ser Val Leu
305                 310                 315                 320

Thr Val Val His Gln Asp Trp Leu Asn Gly Lys Glu Tyr Lys Cys Lys
                325                 330                 335

Val Ser Asn Lys Gly Leu Pro Ala Pro Ile Glu Lys Thr Ile Ser Lys
                340                 345                 350

Thr Lys Gly Gln Pro Arg Glu Pro Gln Val Tyr Thr Leu Pro Pro Ser
        355                 360                 365

Arg Glu Glu Met Thr Lys Asn Gln Val Ser Leu Thr Cys Leu Val Lys
        370                 375                 380

Gly Phe Tyr Pro Ser Asp Ile Ala Val Glu Trp Glu Ser Asn Gly Gln
385                 390                 395                 400

Pro Glu Asn Asn Tyr Lys Thr Thr Pro Pro Met Leu Asp Ser Asp Gly
                405                 410                 415

Ser Phe Phe Leu Tyr Ser Lys Leu Thr Val Asp Lys Ser Arg Trp Gln
                420                 425                 430
```

FIGURE 9 Continued...

```
Gln Gly Asn Val Phe Ser Cys Ser Val Met His Glu Ala Leu His Asn
        435                 440                 445

His Tyr Thr Gln Lys Ser Leu Ser Leu Ser Pro Gly Lys
        450                 455                 460

<210> 116
<211> 461
<212> PRT
<213> Homo sapiens

<400> 116

Met Ala Trp Val Trp Thr Leu Pro Phe Leu Met Ala Ala Ala Gln Ser
1               5                   10                  15

Val Gln Ala Gln Val Gln Leu Val Glu Ser Gly Gly Gly Leu Val Gln
            20                  25                  30

Pro Gly Gly Ser Leu Arg Leu Ser Cys Ala Ala Ser Gly Phe Thr Phe
        35                  40                  45

Arg Ser His Trp Leu Ser Trp Val Arg Gln Ala Pro Gly Lys Gly Leu
    50                  55                  60

Glu Trp Val Ser Val Ile Gly Asn Trp Gly Asp Thr Tyr Tyr Ala Asp
65                  70                  75                  80

Ser Val Lys Gly Arg Phe Thr Ile Ser Arg Asp Asn Ser Lys Asn Thr
                85                  90                  95

Leu Tyr Leu Gln Met Asn Ser Leu Arg Ala Glu Asp Thr Ala Val Tyr
            100                 105                 110

Tyr Cys Ala Arg Asp Thr Tyr Leu His Phe Asp Tyr Trp Gly Gln Gly
        115                 120                 125

Thr Leu Val Thr Val Ser Ser Ala Ser Thr Lys Gly Pro Ser Val Phe
    130                 135                 140

Pro Leu Ala Pro Cys Ser Arg Ser Thr Ser Glu Ser Thr Ala Ala Leu
145                 150                 155                 160

Gly Cys Leu Val Lys Asp Tyr Phe Pro Glu Pro Val Thr Val Ser Trp
                165                 170                 175

Asn Ser Gly Ala Leu Thr Ser Gly Val His Thr Phe Pro Ala Val Leu
```

Gln Ser Ser Gly Leu Tyr Ser Leu Ser Ser Val Val Thr Val Pro Ser
                195                     200                     205

Ser Asn Phe Gly Thr Gln Thr Tyr Thr Cys Asn Val Asp His Lys Pro
                210                     215                     220

Ser Asn Thr Lys Val Asp Lys Thr Val Glu Arg Lys Cys Cys Val Glu
        225                     230                     235                     240

Cys Pro Pro Cys Pro Ala Pro Pro Val Ala Gly Pro Ser Val Phe Leu
                        245                     250                     255

Phe Pro Pro Lys Pro Lys Asp Thr Leu Met Ile Ser Arg Thr Pro Glu
                        260                     265                     270

Val Thr Cys Val Val Val Asp Val Ser His Glu Asp Pro Glu Val Gln
                    275                     280                     285

Phe Asn Trp Tyr Val Asp Gly Val Glu Val His Asn Ala Lys Thr Lys
                    290                     295                     300

Pro Arg Glu Glu Gln Phe Asn Ser Thr Phe Arg Val Val Ser Val Leu
        305                     310                     315                     320

Thr Val Val His Gln Asp Trp Leu Asn Gly Lys Glu Tyr Lys Cys Lys
                        325                     330                     335

Val Ser Asn Lys Gly Leu Pro Ala Pro Ile Glu Lys Thr Ile Ser Lys
                        340                     345                     350

Thr Lys Gly Gln Pro Arg Glu Pro Gln Val Tyr Thr Leu Pro Pro Ser
                    355                     360                     365

Arg Glu Glu Met Thr Lys Asn Gln Val Ser Leu Thr Cys Leu Val Lys
                370                     375                     380

Gly Phe Tyr Pro Ser Asp Ile Ala Val Glu Trp Glu Ser Asn Gly Gln
        385                     390                     395                     400

Pro Glu Asn Asn Tyr Lys Thr Thr Pro Pro Met Leu Asp Ser Asp Gly
                        405                     410                     415

Ser Phe Phe Leu Tyr Ser Lys Leu Thr Val Asp Lys Ser Arg Trp Gln
                        420                     425                     430
```

FIGURE 9 Continued...

```
            Gln Gly Asn Val Phe Ser Cys Ser Val Met His Glu Ala Leu His Asn
                    435                 440                 445

His Tyr Thr Gln Lys Ser Leu Ser Leu Ser Pro Gly Lys
                    450                 455                 460

<210>   117
<211>   461
<212>   PRT
<213>   Homo sapiens

<400>   117

Met Ala Trp Val Trp Thr Leu Pro Phe Leu Met Ala Ala Ala Gln Ser
            1               5                   10                  15

Val Gln Ala Gln Val Gln Leu Val Glu Ser Gly Gly Gly Leu Val Gln
                            20                  25                  30

Pro Gly Gly Ser Leu Arg Leu Ser Cys Ala Ala Ser Gly Phe Thr Phe
                        35                  40                  45

Arg Ser His Trp Leu Ser Trp Val Arg Gln Ala Pro Gly Lys Gly Leu
            50                  55                  60

Glu Trp Val Ser Val Thr Thr His Gln Gly Tyr Thr Tyr Tyr Ala Asp
            65                  70                  75                  80

Ser Val Lys Gly Arg Phe Thr Ile Ser Arg Asp Asn Ser Lys Asn Thr
                            85                  90                  95

Leu Tyr Leu Gln Met Asn Ser Leu Arg Ala Glu Asp Thr Ala Val Tyr
                        100                 105                 110

Tyr Cys Ala Arg Asp Thr Tyr Leu His Phe Asp Tyr Trp Gly Gln Gly
                    115                 120                 125

Thr Leu Val Thr Val Ser Ser Ala Ser Thr Lys Gly Pro Ser Val Phe
                    130                 135                 140

Pro Leu Ala Pro Cys Ser Arg Ser Thr Ser Glu Ser Thr Ala Ala Leu
            145                 150                 155                 160

Gly Cys Leu Val Lys Asp Tyr Phe Pro Glu Pro Val Thr Val Ser Trp
                            165                 170                 175
```

FIGURE 9 Continued...

```
Asn Ser Gly Ala Leu Thr Ser Gly Val His Thr Phe Pro Ala Val Leu
            180             185             190

Gln Ser Ser Gly Leu Tyr Ser Leu Ser Ser Val Val Thr Val Pro Ser
        195             200             205

Ser Asn Phe Gly Thr Gln Thr Tyr Thr Cys Asn Val Asp His Lys Pro
    210             215             220

Ser Asn Thr Lys Val Asp Lys Thr Val Glu Arg Lys Cys Cys Val Glu
225             230             235             240

Cys Pro Pro Cys Pro Ala Pro Pro Val Ala Gly Pro Ser Val Phe Leu
            245             250             255

Phe Pro Pro Lys Pro Lys Asp Thr Leu Met Ile Ser Arg Thr Pro Glu
            260             265             270

Val Thr Cys Val Val Val Asp Val Ser His Glu Asp Pro Glu Val Gln
        275             280             285

Phe Asn Trp Tyr Val Asp Gly Val Glu Val His Asn Ala Lys Thr Lys
        290             295             300

Pro Arg Glu Glu Gln Phe Asn Ser Thr Phe Arg Val Val Ser Val Leu
305             310             315             320

Thr Val Val His Gln Asp Trp Leu Asn Gly Lys Glu Tyr Lys Cys Lys
            325             330             335

Val Ser Asn Lys Gly Leu Pro Ala Pro Ile Glu Lys Thr Ile Ser Lys
            340             345             350

Thr Lys Gly Gln Pro Arg Glu Pro Gln Val Tyr Thr Leu Pro Pro Ser
        355             360             365

Arg Glu Glu Met Thr Lys Asn Gln Val Ser Leu Thr Cys Leu Val Lys
        370             375             380

Gly Phe Tyr Pro Ser Asp Ile Ala Val Glu Trp Glu Ser Asn Gly Gln
385             390             395             400

Pro Glu Asn Asn Tyr Lys Thr Thr Pro Pro Met Leu Asp Ser Asp Gly
            405             410             415

Ser Phe Phe Leu Tyr Ser Lys Leu Thr Val Asp Lys Ser Arg Trp Gln
```

Gln Gly Asn Val Phe Ser Cys Ser Val Met His Glu Ala Leu His Asn
                435                 440                445

His Tyr Thr Gln Lys Ser Leu Ser Leu Ser Pro Gly Lys
                450                 455                460

<210>   118
<211>   465
<212>   PRT
<213>   Homo sapiens

<400>   118

Met Lys His Leu Trp Phe Phe Leu Leu Leu Val Ala Ala Pro Arg Trp
1               5                   10                  15

Val Leu Ser Gln Val Gln Leu Val Glu Ser Gly Gly Gly Leu Val Gln
                20                  25                  30

Pro Gly Gly Ser Leu Arg Leu Ser Cys Ala Ala Ser Gly Phe Thr Phe
                35                  40                  45

Arg Ser His Trp Leu Ser Trp Val Arg Gln Ala Pro Gly Lys Gly Leu
        50                  55                  60

Glu Trp Val Ser Ala Thr Asn Arg Tyr Gly Tyr Thr Tyr Tyr Ala Asp
65                  70                  75                  80

Ser Val Lys Gly Arg Phe Thr Ile Ser Arg Asp Asn Ser Lys Asn Thr
                85                  90                  95

Leu Tyr Leu Gln Met Asn Ser Leu Arg Ala Glu Asp Thr Ala Val Tyr
                100                 105                 110

Tyr Cys Ala Arg Asp Thr Tyr Leu His Phe Asp Tyr Trp Gly Gln Gly
                115                 120                 125

Thr Leu Val Thr Val Ser Ser Ala Lys Thr Thr Ala Pro Ser Val Tyr
                130                 135                 140

Pro Leu Ala Pro Val Cys Gly Asp Thr Thr Gly Ser Ser Val Thr Leu
145                 150                 155                 160

Gly Cys Leu Val Lys Gly Tyr Phe Pro Glu Pro Val Thr Leu Thr Trp
                165                 170                 175
```

FIGURE 9 Continued...

```
Asn Ser Gly Ser Leu Ser Ser Gly Val His Thr Phe Pro Ala Val Leu
            180             185             190

Gln Ser Asp Leu Tyr Thr Leu Ser Ser Val Thr Val Thr Ser Ser
        195             200             205

Thr Trp Pro Ser Gln Ser Ile Thr Cys Asn Val Ala His Pro Ala Ser
    210             215             220

Ser Thr Lys Val Asp Lys Lys Ile Glu Pro Arg Gly Pro Thr Ile Lys
225             230             235             240

Pro Cys Pro Pro Cys Lys Cys Pro Ala Pro Asn Leu Leu Gly Gly Pro
            245             250             255

Ser Val Phe Ile Phe Pro Pro Lys Ile Lys Asp Val Leu Met Ile Ser
            260             265             270

Leu Ser Pro Ile Val Thr Cys Val Val Val Asp Val Ser Glu Asp Asp
        275             280             285

Pro Asp Val Gln Ile Ser Trp Phe Val Asn Asn Val Glu Val His Thr
    290             295             300

Ala Gln Thr Gln Thr His Arg Glu Asp Tyr Asn Ser Thr Leu Arg Val
305             310             315             320

Val Ser Ala Leu Pro Ile Gln His Gln Asp Trp Met Ser Gly Lys Glu
            325             330             335

Phe Lys Cys Lys Val Asn Asn Lys Asp Leu Pro Ala Pro Ile Glu Arg
            340             345             350

Thr Ile Ser Lys Pro Lys Gly Ser Val Arg Ala Pro Gln Val Tyr Val
        355             360             365

Leu Pro Pro Pro Glu Glu Glu Met Thr Lys Lys Gln Val Thr Leu Thr
    370             375             380

Cys Met Val Thr Asp Phe Met Pro Glu Asp Ile Tyr Val Glu Trp Thr
385             390             395             400

Asn Asn Gly Lys Thr Glu Leu Asn Tyr Lys Asn Thr Glu Pro Val Leu
            405             410             415
```

FIGURE 9 Continued...

```
Asp Ser Asp Gly Ser Tyr Phe Met Tyr Ser Lys Leu Arg Val Glu Lys
            420             425             430

Lys Asn Trp Val Glu Arg Asn Ser Tyr Ser Cys Ser Val Val His Glu
        435             440             445

Gly Leu His Asn His His Thr Thr Lys Ser Phe Ser Arg Thr Pro Gly
    450             455             460

Lys
465

<210>  119
<211>  462
<212>  PRT
<213>  Homo sapiens

<400>  119

Met Ala Trp Val Trp Thr Leu Pro Phe Leu Met Ala Ala Ala Gln Ser
1               5               10              15

Val Gln Ala Gln Val Gln Leu Val Glu Ser Gly Gly Gly Leu Val Gln
            20              25              30

Pro Gly Gly Ser Leu Arg Leu Ser Cys Ala Ala Ser Gly Phe Thr Phe
        35              40              45

Arg Ser His Trp Leu Ser Trp Val Arg Gln Ala Pro Gly Lys Gly Leu
    50              55              60

Glu Trp Val Ser Asn Ile Asn Tyr Asp Gly Ser Ser Thr Tyr Tyr Ala
65              70              75              80

Asp Ser Val Lys Gly Arg Phe Thr Ile Ser Arg Asp Asn Ser Lys Asn
            85              90              95

Thr Leu Tyr Leu Gln Met Asn Ser Leu Arg Ala Glu Asp Thr Ala Val
        100             105             110

Tyr Tyr Cys Ala Arg Asp Thr Tyr Leu His Phe Asp Tyr Trp Gly Gln
    115             120             125

Gly Thr Leu Val Thr Val Ser Ser Ala Ser Thr Lys Gly Pro Ser Val
    130             135             140

Phe Pro Leu Ala Pro Cys Ser Arg Ser Thr Ser Glu Ser Thr Ala Ala
145             150             155             160
```

FIGURE 9 Continued...

```
Leu Gly Cys Leu Val Lys Asp Tyr Phe Pro Glu Pro Val Thr Val Ser
            165                 170                 175

Trp Asn Ser Gly Ala Leu Thr Ser Gly Val His Thr Phe Pro Ala Val
            180                 185                 190

Leu Gln Ser Ser Gly Leu Tyr Ser Leu Ser Ser Val Val Thr Val Pro
            195                 200                 205

Ser Ser Asn Phe Gly Thr Gln Thr Tyr Thr Cys Asn Val Asp His Lys
            210                 215                 220

Pro Ser Asn Thr Lys Val Asp Lys Thr Val Glu Arg Lys Cys Cys Val
225                 230                 235                 240

Glu Cys Pro Pro Cys Pro Ala Pro Pro Val Ala Gly Pro Ser Val Phe
            245                 250                 255

Leu Phe Pro Pro Lys Pro Lys Asp Thr Leu Met Ile Ser Arg Thr Pro
            260                 265                 270

Glu Val Thr Cys Val Val Val Asp Val Ser His Glu Asp Pro Glu Val
            275                 280                 285

Gln Phe Asn Trp Tyr Val Asp Gly Val Glu Val His Asn Ala Lys Thr
            290                 295                 300

Lys Pro Arg Glu Glu Gln Phe Asn Ser Thr Phe Arg Val Val Ser Val
305                 310                 315                 320

Leu Thr Val Val His Gln Asp Trp Leu Asn Gly Lys Glu Tyr Lys Cys
            325                 330                 335

Lys Val Ser Asn Lys Gly Leu Pro Ala Pro Ile Glu Lys Thr Ile Ser
            340                 345                 350

Lys Thr Lys Gly Gln Pro Arg Glu Pro Gln Val Tyr Thr Leu Pro Pro
            355                 360                 365

Ser Arg Glu Glu Met Thr Lys Asn Gln Val Ser Leu Thr Cys Leu Val
            370                 375                 380

Lys Gly Phe Tyr Pro Ser Asp Ile Ala Val Glu Trp Glu Ser Asn Gly
385                 390                 395                 400
```

FIGURE 9 Continued...

```
                Gln Pro Glu Asn Asn Tyr Lys Thr Thr Pro Pro Met Leu Asp Ser Asp
                                405                 410                 415

Gly Ser Phe Phe Leu Tyr Ser Lys Leu Thr Val Asp Lys Ser Arg Trp
                                420                 425                 430

Gln Gln Gly Asn Val Phe Ser Cys Ser Val Met His Glu Ala Leu His
                                435                 440                 445

Asn His Tyr Thr Gln Lys Ser Leu Ser Leu Ser Pro Gly Lys
                                450                 455                 460

<210>   120
<211>   461
<212>   PRT
<213>   Homo sapiens

<400>   120

Met Ala Trp Val Trp Thr Leu Pro Phe Leu Met Ala Ala Ala Gln Ser
1               5                   10                  15

Val Gln Ala Gln Val Gln Leu Val Glu Ser Gly Gly Gly Leu Val Gln
                20                  25                  30

Pro Gly Gly Ser Leu Arg Leu Ser Cys Ala Ala Ser Gly Phe Thr Phe
                35                  40                  45

Arg Ser His Trp Leu Ser Trp Val Arg Gln Ala Pro Gly Lys Gly Leu
                50                  55                  60

Glu Trp Val Ser Val Ile Thr Pro Tyr Gly Asp Thr Tyr Tyr Ala Asp
65                  70                  75                  80

Ser Val Lys Gly Arg Phe Thr Ile Ser Arg Asp Asn Ser Lys Asn Thr
                85                  90                  95

Leu Tyr Leu Gln Met Asn Ser Leu Arg Ala Glu Asp Thr Ala Val Tyr
                100                 105                 110

Tyr Cys Ala Arg Asp Thr Tyr Leu His Phe Asp Tyr Trp Gly Gln Gly
                115                 120                 125

Thr Leu Val Thr Val Ser Ser Ala Ser Thr Lys Gly Pro Ser Val Phe
                130                 135                 140

Pro Leu Ala Pro Cys Ser Arg Ser Thr Ser Glu Ser Thr Ala Ala Leu
```

Gly Cys Leu Val Lys Asp Tyr Phe Pro Glu Pro Val Thr Val Ser Trp
                    165                 170                 175

Asn Ser Gly Ala Leu Thr Ser Gly Val His Thr Phe Pro Ala Val Leu
                    180                 185                 190

Gln Ser Ser Gly Leu Tyr Ser Leu Ser Ser Val Val Thr Val Pro Ser
                    195                 200                 205

Ser Asn Phe Gly Thr Gln Thr Tyr Thr Cys Asn Val Asp His Lys Pro
        210                 215                 220

Ser Asn Thr Lys Val Asp Lys Thr Val Glu Arg Lys Cys Cys Val Glu
    225                 230                 235                 240

Cys Pro Pro Cys Pro Ala Pro Pro Val Ala Gly Pro Ser Val Phe Leu
                    245                 250                 255

Phe Pro Pro Lys Pro Lys Asp Thr Leu Met Ile Ser Arg Thr Pro Glu
                    260                 265                 270

Val Thr Cys Val Val Val Asp Val Ser His Glu Asp Pro Glu Val Gln
                    275                 280                 285

Phe Asn Trp Tyr Val Asp Gly Val Glu Val His Asn Ala Lys Thr Lys
        290                 295                 300

Pro Arg Glu Glu Gln Phe Asn Ser Thr Phe Arg Val Val Ser Val Leu
    305                 310                 315                 320

Thr Val Val His Gln Asp Trp Leu Asn Gly Lys Glu Tyr Lys Cys Lys
                    325                 330                 335

Val Ser Asn Lys Gly Leu Pro Ala Pro Ile Glu Lys Thr Ile Ser Lys
                    340                 345                 350

Thr Lys Gly Gln Pro Arg Glu Pro Gln Val Tyr Thr Leu Pro Pro Ser
                    355                 360                 365

Arg Glu Glu Met Thr Lys Asn Gln Val Ser Leu Thr Cys Leu Val Lys
                    370                 375                 380

Gly Phe Tyr Pro Ser Asp Ile Ala Val Glu Trp Glu Ser Asn Gly Gln
    385                 390                 395                 400
```

FIGURE 9 Continued...

```
       Pro Glu Asn Asn Tyr Lys Thr Thr Pro Pro Met Leu Asp Ser Asp Gly
                       405                 410                 415

Ser Phe Phe Leu Tyr Ser Lys Leu Thr Val Asp Lys Ser Arg Trp Gln
                       420                 425                 430

Gln Gly Asn Val Phe Ser Cys Ser Val Met His Glu Ala Leu His Asn
                       435                 440                 445

His Tyr Thr Gln Lys Ser Leu Ser Leu Ser Pro Gly Lys
                       450                 455                 460

<210>  121
<211>  461
<212>  PRT
<213>  Homo sapiens

<400>  121

Met Ala Trp Val Trp Thr Leu Pro Phe Leu Met Ala Ala Ala Gln Ser
1               5                   10                  15

Val Gln Ala Gln Val Gln Leu Val Glu Ser Gly Gly Gly Leu Val Gln
                20                  25                  30

Pro Gly Gly Ser Leu Arg Leu Ser Cys Ala Ala Ser Gly Phe Thr Phe
            35                  40                  45

Arg Ser His Trp Leu Ser Trp Val Arg Gln Ala Pro Gly Lys Gly Leu
        50                  55                  60

Glu Trp Val Ser Val Ile Thr Pro Tyr Gly Asp Thr Tyr Tyr Ala Asp
65                  70                  75                  80

Ser Val Lys Gly Arg Phe Thr Ile Ser Arg Asp Asn Ser Lys Asn Thr
                85                  90                  95

Leu Tyr Leu Gln Met Asn Ser Leu Arg Ala Glu Asp Thr Ala Val Tyr
                100                 105                 110

Tyr Cys Ala Arg Asp Thr Tyr Leu His Phe Asp Tyr Trp Gly Gln Gly
            115                 120                 125

Thr Leu Val Thr Val Ser Ser Ala Ser Thr Lys Gly Pro Ser Val Phe
        130                 135                 140
```

FIGURE 9 Continued...

```
Pro Leu Ala Pro Cys Ser Arg Ser Thr Ser Glu Ser Thr Ala Ala Leu
145                 150                 155                 160

Gly Cys Leu Val Lys Asp Tyr Phe Pro Glu Pro Val Thr Val Ser Trp
                165                 170                 175

Asn Ser Gly Ala Leu Thr Ser Gly Val His Thr Phe Pro Ala Val Leu
                180                 185                 190

Gln Ser Ser Gly Leu Tyr Ser Leu Ser Ser Val Val Thr Val Pro Ser
                195                 200                 205

Ser Asn Phe Gly Thr Gln Thr Tyr Thr Cys Asn Val Asp His Lys Pro
210                 215                 220

Ser Asn Thr Lys Val Asp Lys Thr Val Glu Arg Lys Cys Cys Val Glu
225                 230                 235                 240

Cys Pro Pro Cys Pro Ala Pro Pro Val Ala Gly Pro Ser Val Phe Leu
                245                 250                 255

Phe Pro Pro Lys Pro Lys Asp Thr Leu Met Ile Ser Arg Thr Pro Glu
                260                 265                 270

Val Thr Cys Val Val Val Asp Val Ser His Glu Asp Pro Glu Val Gln
                275                 280                 285

Phe Asn Trp Tyr Val Asp Gly Val Glu Val His Asn Ala Lys Thr Lys
290                 295                 300

Pro Arg Glu Glu Gln Phe Asn Ser Thr Phe Arg Val Val Ser Val Leu
305                 310                 315                 320

Thr Val Val His Gln Asp Trp Leu Asn Gly Lys Glu Tyr Lys Cys Lys
                325                 330                 335

Val Ser Asn Lys Gly Leu Pro Ala Pro Ile Glu Lys Thr Ile Ser Lys
                340                 345                 350

Thr Lys Gly Gln Pro Arg Glu Pro Gln Val Tyr Thr Leu Pro Pro Ser
                355                 360                 365

Arg Glu Glu Met Thr Lys Asn Gln Val Ser Leu Thr Cys Leu Val Lys
                370                 375                 380

Gly Phe Tyr Pro Ser Asp Ile Ala Val Glu Trp Glu Ser Asn Gly Gln
```

Pro Glu Asn Asn Tyr Lys Thr Thr Pro Pro Met Leu Asp Ser Asp Gly
                         405                 410                 415

Ser Phe Phe Leu Tyr Ser Lys Leu Thr Val Asp Lys Ser Arg Trp Gln
                         420                 425                 430

Gln Gly Asn Val Phe Ser Cys Ser Val Met His Glu Ala Leu His Asn
                         435                 440                 445

His Tyr Thr Gln Lys Ser Leu Ser Leu Ser Pro Gly Lys
                         450                 455                 460

<210>  122
    <211>  130
    <212>  PRT
    <213>  Homo sapiens

<400>  122

Met Ser Val Leu Thr Gln Val Leu Ala Leu Leu Leu Leu Trp Leu Thr
    1               5                   10                  15

Gly Thr Arg Cys Asp Ile Glu Leu Thr Gln Pro Pro Ser Val Ser Val
                    20                  25                  30

Ala Pro Gly Gln Thr Ala Arg Ile Ser Cys Ser Gly Asp Asn Ile Gly
                35                  40                  45

Ser Phe Tyr Val His Trp Tyr Gln Gln Lys Pro Gly Gln Ala Pro Val
            50                  55                  60

Leu Val Ile Tyr Asp Asp Asn Asn Arg Pro Ser Gly Ile Pro Glu Arg
    65                  70                  75                  80

Phe Ser Gly Ser Asn Ser Gly Asn Thr Ala Thr Leu Thr Ile Ser Gly
                    85                  90                  95

Thr Gln Ala Glu Asp Glu Ala Asp Tyr Tyr Cys Gly Ser Trp Ala Gly
                100                 105                 110

Ser Ser Gly Ser Tyr Val Phe Gly Gly Arg Thr Lys Leu Thr Val Leu
                115                 120                 125

Gly Gln
    130
```

FIGURE 9 Continued...

```
<210>  123
<211>  237
<212>  PRT
<213>  Homo sapiens

<400>  123
```

Met Ser Val Leu Thr Gln Val Leu Ala Leu Leu Leu Trp Leu Thr
 1               5                  10                  15

Gly Thr Arg Cys Asp Ile Ala Leu Thr Gln Pro Ala Ser Val Ser Gly
            20                  25                  30

Ser Pro Gly Gln Ser Ile Thr Ile Ser Cys Thr Gly Thr Ser Ser Asp
            35                  40                  45

Val Gly Asp Ile Asn Asp Val Ser Trp Tyr Gln Gln His Pro Gly Lys
    50                  55                  60

Ala Pro Lys Leu Met Ile Tyr Asp Val Asn Asn Arg Pro Ser Gly Val
65                  70                  75                  80

Ser Asn Arg Phe Ser Gly Ser Lys Ser Gly Asn Thr Ala Ser Leu Thr
                85                  90                  95

Ile Ser Gly Leu Gln Ala Glu Asp Glu Ala Asp Tyr Tyr Cys Ser Ser
            100                 105                 110

Tyr Gly Glu Ser Leu Thr Ser Tyr Val Phe Gly Gly Gly Thr Lys Leu
        115                 120                 125

Thr Val Leu Gly Gln Pro Lys Ala Ala Pro Ser Val Thr Leu Phe Pro
    130                 135                 140

Pro Ser Ser Glu Glu Leu Gln Ala Asn Lys Ala Thr Leu Val Cys Leu
145                 150                 155                 160

Ile Ser Asp Phe Tyr Pro Gly Ala Val Thr Val Ala Trp Lys Ala Asp
                165                 170                 175

Ser Ser Pro Val Lys Ala Gly Val Glu Thr Thr Thr Pro Ser Lys Gln
            180                 185                 190

Ser Asn Asn Lys Tyr Ala Ala Ser Ser Tyr Leu Ser Leu Thr Pro Glu
        195                 200                 205

Gln Trp Lys Ser His Arg Ser Tyr Ser Cys Gln Val Thr His Glu Gly

Ser Thr Val Glu Lys Thr Val Ala Pro Thr Glu Cys Ser
225                 230                 235

<210>  124
<211>  234
<212>  PRT
<213>  Homo sapiens

<400>  124

Met Ser Val Leu Thr Gln Val Leu Ala Leu Leu Leu Leu Trp Leu Thr
1                   5                   10                  15

Gly Thr Arg Cys Asp Ile Glu Leu Thr Gln Pro Pro Ser Val Ser Val
                    20                  25                  30

Ala Pro Gly Gln Thr Ala Arg Ile Ser Cys Ser Gly Asp Asn Ile Gly
                35                  40                  45

Ser Phe Tyr Val His Trp Tyr Gln Gln Lys Pro Gly Gln Ala Pro Val
            50                  55                  60

Leu Val Ile Tyr Asp Asp Asn Asn Arg Pro Ser Gly Ile Pro Glu Arg
65                  70                  75                  80

Phe Ser Gly Ser Asn Ser Gly Asn Thr Ala Thr Leu Thr Ile Ser Gly
                    85                  90                  95

Thr Gln Ala Glu Asp Glu Ala Asp Tyr Tyr Cys Ala Ser Trp Thr Gly
                100                 105                 110

Val Glu Pro Asp Tyr Val Phe Gly Gly Gly Thr Lys Leu Thr Val Leu
                115                 120                 125

Gly Gln Pro Lys Ala Ala Pro Ser Val Thr Leu Phe Pro Pro Ser Ser
            130                 135                 140

Glu Glu Leu Gln Ala Asn Lys Ala Thr Leu Val Cys Leu Ile Ser Asp
145                 150                 155                 160

Phe Tyr Pro Gly Ala Val Thr Val Ala Trp Lys Ala Asp Ser Ser Pro
                165                 170                 175

Val Lys Ala Gly Val Glu Thr Thr Thr Pro Ser Lys Gln Ser Asn Asn
                180                 185                 190
```

FIGURE 9 Continued...

```
Lys Tyr Ala Ala Ser Ser Tyr Leu Ser Leu Thr Pro Glu Gln Trp Lys
        195                 200                 205

Ser His Arg Ser Tyr Ser Cys Gln Val Thr His Glu Gly Ser Thr Val
        210                 215                 220

Glu Lys Thr Val Ala Pro Thr Glu Cys Ser
225                 230

<210>   125
<211>   237
<212>   PRT
<213>   Homo sapiens

<400>   125

Met Ser Val Leu Thr Gln Val Leu Ala Leu Leu Leu Leu Trp Leu Thr
1               5                   10                  15

Gly Thr Arg Cys Asp Ile Ala Leu Thr Gln Pro Ala Ser Val Ser Gly
            20                  25                  30

Ser Pro Gly Gln Ser Ile Thr Ile Ser Cys Thr Gly Thr Ser Ser Asp
        35                  40                  45

Val Gly Asp Ile Asn Asp Val Ser Trp Tyr Gln Gln His Pro Gly Lys
        50                  55                  60

Ala Pro Lys Leu Met Ile Tyr Asp Val Asn Asn Arg Pro Ser Gly Val
65                  70                  75                  80

Ser Asn Arg Phe Ser Gly Ser Lys Ser Gly Asn Thr Ala Ser Leu Thr
                85                  90                  95

Ile Ser Gly Leu Gln Ala Glu Asp Glu Ala Asp Tyr Tyr Cys Gln Ser
            100                 105                 110

Tyr Ala Gly Ser Tyr Leu Ser Glu Val Phe Gly Gly Gly Thr Lys Leu
        115                 120                 125

Thr Val Leu Gly Gln Pro Lys Ala Ala Pro Ser Val Thr Leu Phe Pro
        130                 135                 140

Pro Ser Ser Glu Glu Leu Gln Ala Asn Lys Ala Thr Leu Val Cys Leu
145                 150                 155                 160

Ile Ser Asp Phe Tyr Pro Gly Ala Val Thr Val Ala Trp Lys Ala Asp
```

Ser Ser Pro Val Lys Ala Gly Val Glu Thr Thr Thr Pro Ser Lys Gln
                    180                     185                 190

Ser Asn Asn Lys Tyr Ala Ala Ser Ser Tyr Leu Ser Leu Thr Pro Glu
                        195                     200                 205

Gln Trp Lys Ser His Arg Ser Tyr Ser Cys Gln Val Thr His Glu Gly
                210                     215                 220

Ser Thr Val Glu Lys Thr Val Ala Pro Thr Glu Cys Ser
        225                     230                 235

<210>   126
<211>   237
<212>   PRT
<213>   Homo sapiens

<400>   126

Met Ser Val Leu Thr Gln Val Leu Ala Leu Leu Leu Leu Trp Leu Thr
        1               5                   10                  15

Gly Thr Arg Cys Asp Ile Ala Leu Thr Gln Pro Ala Ser Val Ser Gly
                        20                  25                  30

Ser Pro Gly Gln Ser Ile Thr Ile Ser Cys Thr Gly Thr Ser Ser Asp
                    35                  40                  45

Val Gly Asp Ile Asn Asp Val Ser Trp Tyr Gln Gln His Pro Gly Lys
                50                  55                  60

Ala Pro Lys Leu Met Ile Tyr Asp Val Asn Asn Arg Pro Ser Gly Val
        65                  70                  75                  80

Ser Asn Arg Phe Ser Gly Ser Lys Ser Gly Asn Thr Ala Ser Leu Thr
                        85                  90                  95

Ile Ser Gly Leu Gln Ala Glu Asp Glu Ala Asp Tyr Tyr Cys Ser Ser
                    100                 105                 110

Tyr Gly Glu Ser Leu Thr Ser Tyr Val Phe Gly Gly Gly Thr Lys Leu
                    115                 120                 125

Thr Val Leu Gly Gln Pro Lys Ala Ala Pro Ser Val Thr Leu Phe Pro
                130                 135                 140
```

FIGURE 9 Continued...

```
Pro Ser Ser Glu Glu Leu Gln Ala Asn Lys Ala Thr Leu Val Cys Leu
145                 150                 155                 160

Ile Ser Asp Phe Tyr Pro Gly Ala Val Thr Val Ala Trp Lys Ala Asp
                165                 170                 175

Ser Ser Pro Val Lys Ala Gly Val Glu Thr Thr Thr Pro Ser Lys Gln
                180                 185                 190

Ser Asn Asn Lys Tyr Ala Ala Ser Ser Tyr Leu Ser Leu Thr Pro Glu
            195                 200                 205

Gln Trp Lys Ser His Arg Ser Tyr Ser Cys Gln Val Thr His Glu Gly
            210                 215                 220

Ser Thr Val Glu Lys Thr Val Ala Pro Thr Glu Cys Ser
225                 230                 235
```

<210> 127
<211> 237
<212> PRT
<213> Homo sapiens

<400> 127

```
Met Ser Val Leu Thr Gln Val Leu Ala Leu Leu Leu Leu Trp Leu Thr
1               5                   10                  15

Gly Thr Arg Cys Asp Ile Ala Leu Thr Gln Pro Ala Ser Val Ser Gly
                20                  25                  30

Ser Pro Gly Gln Ser Ile Thr Ile Ser Cys Thr Gly Thr Ser Ser Asp
                35                  40                  45

Val Gly Asp Ile Asn Asp Val Ser Trp Tyr Gln Gln His Pro Gly Lys
            50                  55                  60

Ala Pro Lys Leu Met Ile Tyr Asp Val Asn Asn Arg Pro Ser Gly Val
65                  70                  75                  80

Ser Asn Arg Phe Ser Gly Ser Lys Ser Gly Asn Thr Ala Ser Leu Thr
                85                  90                  95

Ile Ser Gly Leu Gln Ala Glu Asp Glu Ala Asp Tyr Tyr Cys Ser Ser
                100                 105                 110

Tyr Gly Glu Ser Leu Thr Ser Tyr Val Phe Gly Gly Gly Thr Lys Leu
```

Thr Val Leu Gly Gln Pro Lys Ala Ala Pro Ser Val Thr Leu Phe Pro
    130                 135                 140

Pro Ser Ser Glu Glu Leu Gln Ala Asn Lys Ala Thr Leu Val Cys Leu
145                 150                 155                 160

Ile Ser Asp Phe Tyr Pro Gly Ala Val Thr Val Ala Trp Lys Ala Asp
                165                 170                 175

Ser Ser Pro Val Lys Ala Gly Val Glu Thr Thr Thr Pro Ser Lys Gln
            180                 185                 190

Ser Asn Asn Lys Tyr Ala Ala Ser Ser Tyr Leu Ser Leu Thr Pro Glu
            195                 200                 205

Gln Trp Lys Ser His Arg Ser Tyr Ser Cys Gln Val Thr His Glu Gly
    210                 215                 220

Ser Thr Val Glu Lys Thr Val Ala Pro Thr Glu Cys Ser
225                 230                 235

<210>  128
<211>  237
<212>  PRT
<213>  Homo sapiens

<400>  128

Met Ser Val Leu Thr Gln Val Leu Ala Leu Leu Leu Leu Trp Leu Thr
1               5                   10                  15

Gly Thr Arg Cys Asp Ile Ala Leu Thr Gln Pro Ala Ser Val Ser Gly
                20                  25                  30

Ser Pro Gly Gln Ser Ile Thr Ile Ser Cys Thr Gly Thr Ser Ser Asp
            35                  40                  45

Val Gly Asp Ile Asn Asp Val Ser Trp Tyr Gln Gln His Pro Gly Lys
        50                  55                  60

Ala Pro Lys Leu Met Ile Tyr Asp Val Asn Asn Arg Pro Ser Gly Val
65                  70                  75                  80

Ser Asn Arg Phe Ser Gly Ser Lys Ser Gly Asn Thr Ala Ser Leu Thr
                85                  90                  95
```

FIGURE 9 Continued...

```
    Ile Ser Gly Leu Gln Ala Glu Asp Glu Ala Asp Tyr Tyr Cys Ser Ser
                100                 105                 110

Tyr Gly Glu Ser Leu Thr Ser Tyr Val Phe Gly Gly Gly Thr Lys Leu
            115                 120                 125

Thr Val Leu Gly Gln Pro Lys Ala Ala Pro Ser Val Thr Leu Phe Pro
        130                 135                 140

Pro Ser Ser Glu Glu Leu Gln Ala Asn Lys Ala Thr Leu Val Cys Leu
    145                 150                 155                 160

Ile Ser Asp Phe Tyr Pro Gly Ala Val Thr Val Ala Trp Lys Ala Asp
                    165                 170                 175

Ser Ser Pro Val Lys Ala Gly Val Glu Thr Thr Thr Pro Ser Lys Gln
                180                 185                 190

Ser Asn Asn Lys Tyr Ala Ala Ser Ser Tyr Leu Ser Leu Thr Pro Glu
                195                 200                 205

Gln Trp Lys Ser His Arg Ser Tyr Ser Cys Gln Val Thr His Glu Gly
        210                 215                 220

Ser Thr Val Glu Lys Thr Val Ala Pro Thr Glu Cys Ser
    225                 230                 235
```

<210> 129
<211> 237
<212> PRT
<213> Homo sapiens

<400> 129

```
    Met Ser Val Leu Thr Gln Val Leu Ala Leu Leu Leu Leu Trp Leu Thr
    1               5                   10                  15

Gly Thr Arg Cys Asp Ile Ala Leu Thr Gln Pro Ala Ser Val Ser Gly
                20                  25                  30

Ser Pro Gly Gln Ser Ile Thr Ile Ser Cys Thr Gly Thr Ser Ser Asp
                35                  40                  45

Val Gly Asp Ile Asn Asp Val Ser Trp Tyr Gln Gln His Pro Gly Lys
            50                  55                  60

Ala Pro Lys Leu Met Ile Tyr Asp Val Asn Asn Arg Pro Ser Gly Val
```

Ser Asn Arg Phe Ser Gly Ser Lys Ser Gly Asn Thr Ala Ser Leu Thr
                     85                  90                  95

Ile Ser Gly Leu Gln Ala Glu Asp Glu Ala Asp Tyr Tyr Cys Ser Ser
                     100                 105                 110

Tyr Gly Glu Ser Leu Thr Ser Tyr Val Phe Gly Gly Gly Thr Lys Leu
             115                 120                 125

Thr Val Leu Gly Gln Pro Lys Ala Ala Pro Ser Val Thr Leu Phe Pro
         130                 135                 140

Pro Ser Ser Glu Glu Leu Gln Ala Asn Lys Ala Thr Leu Val Cys Leu
     145                 150                 155                 160

Ile Ser Asp Phe Tyr Pro Gly Ala Val Thr Val Ala Trp Lys Ala Asp
                     165                 170                 175

Ser Ser Pro Val Lys Ala Gly Val Glu Thr Thr Thr Pro Ser Lys Gln
                     180                 185                 190

Ser Asn Asn Lys Tyr Ala Ala Ser Ser Tyr Leu Ser Leu Thr Pro Glu
                     195                 200                 205

Gln Trp Lys Ser His Arg Ser Tyr Ser Cys Gln Val Thr His Glu Gly
                 210                 215                 220

Ser Thr Val Glu Lys Thr Val Ala Pro Thr Glu Cys Ser
     225                 230                 235

<210> 130
     <211> 237
     <212> PRT
     <213> Homo sapiens

<400> 130

Met Ser Val Leu Thr Gln Val Leu Ala Leu Leu Leu Leu Trp Leu Thr
     1               5                   10                  15

Gly Thr Arg Cys Asp Ile Ala Leu Thr Gln Pro Ala Ser Val Ser Gly
                     20                  25                  30

Ser Pro Gly Gln Ser Ile Thr Ile Ser Cys Thr Gly Thr Ser Ser Asp
                     35                  40                  45
```

FIGURE 9 Continued...

```
Val Gly Asp Ile Asn Asp Val Ser Trp Tyr Gln Gln His Pro Gly Lys
        50                  55                  60

Ala Pro Lys Leu Met Ile Tyr Asp Val Asn Asn Arg Pro Ser Gly Val
65                  70                  75                  80

Ser Asn Arg Phe Ser Gly Ser Lys Ser Gly Asn Thr Ala Ser Leu Thr
                85                  90                  95

Ile Ser Gly Leu Gln Ala Glu Asp Glu Ala Asp Tyr Tyr Cys Ser Thr
                100                 105                 110

Tyr Asp Gly Pro Gly Leu Ser Glu Val Phe Gly Gly Gly Thr Lys Leu
        115                 120                 125

Thr Val Leu Gly Gln Pro Lys Ala Ala Pro Ser Val Thr Leu Phe Pro
        130                 135                 140

Pro Ser Ser Glu Glu Leu Gln Ala Asn Lys Ala Thr Leu Val Cys Leu
145                 150                 155                 160

Ile Ser Asp Phe Tyr Pro Gly Ala Val Thr Val Ala Trp Lys Ala Asp
                165                 170                 175

Ser Ser Pro Val Lys Ala Gly Val Glu Thr Thr Thr Pro Ser Lys Gln
                180                 185                 190

Ser Asn Asn Lys Tyr Ala Ala Ser Ser Tyr Leu Ser Leu Thr Pro Glu
            195                 200                 205

Gln Trp Lys Ser His Arg Ser Tyr Ser Cys Gln Val Thr His Glu Gly
        210                 215                 220

Ser Thr Val Glu Lys Thr Val Ala Pro Thr Glu Cys Ser
225                 230                 235

<210>   131
<211>   237
<212>   PRT
<213>   Homo sapiens

<400>   131

Met Ser Val Leu Thr Gln Val Leu Ala Leu Leu Leu Leu Trp Leu Thr
1               5                   10                  15

Gly Thr Arg Cys Asp Ile Ala Leu Thr Gln Pro Ala Ser Val Ser Gly
```

Ser Pro Gly Gln Ser Ile Thr Ile Ser Cys Thr Gly Thr Ser Ser Asp
        35                  40                  45

Val Gly Asp Ile Asn Asp Val Ser Trp Tyr Gln Gln His Pro Gly Lys
        50                  55                  60

Ala Pro Lys Leu Met Ile Tyr Asp Val Asn Asn Arg Pro Ser Gly Val
65                      70                  75                  80

Ser Asn Arg Phe Ser Gly Ser Lys Ser Gly Asn Thr Ala Ser Leu Thr
                    85                  90                  95

Ile Ser Gly Leu Gln Ala Glu Asp Glu Ala Asp Tyr Tyr Cys Ser Ser
                100                 105                 110

Tyr Gly Glu Ser Leu Thr Ser Tyr Val Phe Gly Gly Gly Thr Lys Leu
            115                 120                 125

Thr Val Leu Gly Gln Pro Lys Ala Ala Pro Ser Val Thr Leu Phe Pro
130                     135                 140

Pro Ser Ser Glu Glu Leu Gln Ala Asn Lys Ala Thr Leu Val Cys Leu
145                 150                 155                 160

Ile Ser Asp Phe Tyr Pro Gly Ala Val Thr Val Ala Trp Lys Ala Asp
                165                 170                 175

Ser Ser Pro Val Lys Ala Gly Val Glu Thr Thr Thr Pro Ser Lys Gln
            180                 185                 190

Ser Asn Asn Lys Tyr Ala Ala Ser Ser Tyr Leu Ser Leu Thr Pro Glu
        195                 200                 205

Gln Trp Lys Ser His Arg Ser Tyr Ser Cys Gln Val Thr His Glu Gly
        210                 215                 220

Ser Thr Val Glu Lys Thr Val Ala Pro Thr Glu Cys Ser
225                 230                 235

<210>  132
<211>  237
<212>  PRT
<213>  Homo sapiens

```
Met Ser Val Leu Thr Gln Val Leu Ala Leu Leu Leu Trp Leu Thr
1           5              10                  15

Gly Thr Arg Cys Asp Ile Ala Leu Thr Gln Pro Ala Ser Val Ser Gly
            20                  25              30

Ser Pro Gly Gln Ser Ile Thr Ile Ser Cys Thr Gly Thr Ser Ser Asp
            35              40              45

Val Gly Asp Ile Asn Asp Val Ser Trp Tyr Gln Gln His Pro Gly Lys
    50              55              60

Ala Pro Lys Leu Met Ile Tyr Asp Val Asn Asn Arg Pro Ser Gly Val
65              70              75                  80

Ser Asn Arg Phe Ser Gly Ser Lys Ser Gly Asn Thr Ala Ser Leu Thr
                85              90                  95

Ile Ser Gly Leu Gln Ala Glu Asp Glu Ala Asp Tyr Tyr Cys Ser Thr
            100             105             110

Tyr Asp Gly Pro Gly Leu Ser Glu Val Phe Gly Gly Gly Thr Lys Leu
            115             120             125

Thr Val Leu Gly Gln Pro Lys Ala Ala Pro Ser Val Thr Leu Phe Pro
    130             135             140

Pro Ser Ser Glu Glu Leu Gln Ala Asn Lys Ala Thr Leu Val Cys Leu
145             150             155             160

Ile Ser Asp Phe Tyr Pro Gly Ala Val Thr Val Ala Trp Lys Ala Asp
            165             170             175

Ser Ser Pro Val Lys Ala Gly Val Glu Thr Thr Thr Pro Ser Lys Gln
            180             185             190

Ser Asn Asn Lys Tyr Ala Ala Ser Ser Tyr Leu Ser Leu Thr Pro Glu
            195             200             205

Gln Trp Lys Ser His Arg Ser Tyr Ser Cys Gln Val Thr His Glu Gly
            210             215             220

Ser Thr Val Glu Lys Thr Val Ala Pro Thr Glu Cys Ser
225             230             235
```

FIGURE 9 Continued...

<210> 133
<211> 1410
<212> DNA
<213> Homo sapiens

<400> 133

| | | | | | | |
|---|---|---|---|---|---|---|
| atggcttggg | tgtggacctt | gccattcctg | atggcagctg | cccaaagcgt | gcaggcccag | 60 |
| gtgcagctgg | tcgagtctgg | cggcggactg | gtgcagcctg | gcggcagcct | gagactgagc | 120 |
| tgcgccgcca | gcggcttcac | cttcagcagc | tacgtgatga | ctgggtgcg | gcaggcccct | 180 |
| ggcaagggcc | tggagtgggt | gtccttcatc | agcggcgaca | gcagcaacac | ctactacgcc | 240 |
| gacagcgtga | agggccggtt | caccatcagc | cgggacaaca | gcaagaacac | cctgtacctg | 300 |
| cagatgaaca | gcctgcgggc | cgaggacacc | gccgtgtact | actgcgcccg | gaccttcatg | 360 |
| cacggccacc | tgggcggagg | actgagcatg | gatttctggg | gccagggcac | cctggtcacc | 420 |
| gtctcctcag | cttccaccaa | gggcccatcc | gtcttccccc | tggcgccctg | ctccaggagc | 480 |
| acctccgaga | gcacagcggc | cctgggctgc | ctggtcaagg | actacttccc | cgaaccggtg | 540 |
| acggtgtcgt | ggaactcagg | cgctctgacc | agcggcgtgc | acaccttccc | agctgtccta | 600 |
| cagtcctcag | gactctactc | cctcagcagc | gtggtgacag | tgccctccag | caacttcggc | 660 |
| acccagacct | acacctgcaa | cgtagatcac | aagcccagca | acaccaaggt | ggacaagaca | 720 |
| gttgagcgca | aatgttgtgt | cgagtgccca | ccgtgcccag | caccacctgt | ggcaggaccg | 780 |
| tcagtcttcc | tcttcccccc | aaaacccaag | gacaccctca | tgatctcccg | gacccctgag | 840 |
| gtcacgtgcg | tggtggtgga | cgtgagccac | gaagaccccg | aggtccagtt | caactggtac | 900 |
| gtggacggcg | tggaggtgca | taatgccaag | acaaagccac | gggaggagca | gttcaacagc | 960 |
| acgttccgtg | tggtcagcgt | cctcaccgtt | gtgcaccagg | actggctgaa | cggcaaggag | 1020 |
| tacaagtgca | aggtctccaa | caaaggcctc | ccagccccca | tcgagaaaac | catctccaaa | 1080 |
| accaaagggc | agccccgaga | accacaggtg | tacaccctgc | ccccatcccg | ggaggagatg | 1140 |
| accaagaacc | aggtcagcct | gacctgcctg | gtcaaaggct | tctaccccag | cgacatcgcc | 1200 |
| gtggagtggg | agagcaatgg | gcagccggag | aacaactaca | agaccacacc | tcccatgctg | 1260 |
| gactccgacg | gctccttctt | cctctacagc | aagctcaccg | tggacaagag | caggtggcag | 1320 |
| caggggaacg | tcttctcatg | ctccgtgatg | catgaggctc | tgcacaacca | ctacacgcag | 1380 |
| aagagcctct | ccctgtctcc | gggtaaatga | | | | 1410 |

<210> 134
<211> 1389
<212> DNA
<213> Homo sapiens

```
atggcttggg tgtggacctt gccattcctg atggcagctg cccaaggtgt ccaggcccag      60
gtgcagctgg tcgagagcgg cggagggctg gtgcagcctg gcggcagcct gagactgagc     120
tgcgccgcca gcggcttcac cttcagaagc cactggctgt cctgggtgcg gcaggcccct     180
ggcaagggcc tggaatgggt gtccaacatc aactacgacg gcagcagcac ctactacgcc     240
gacagcgtga agggccggtt caccatcagc cgggacaaca gcaagaacac cctgtacctg     300
cagatgaaca gcctgcgggc cgaggacacc gccgtgtact actgcgccag ggacacctac     360
ctgcacttcg actactgggg ccagggcacc ctggtcaccg tctcctcagc ttccaccaag     420
ggcccatccg tcttccccct ggcgccctgc tccaggagca cctccgagag cacagcggcc     480
ctgggctgcc tggtcaagga ctacttcccc gaaccggtga cggtgtcgtg gaactcaggc     540
gctctgacca gcggcgtgca caccttccca gctgtcctac agtcctcagg actctactcc     600
ctcagcagcg tggtgacagt gccctccagc aacttcggca cccagaccta cacctgcaac     660
gtagatcaca agcccagcaa caccaaggtg gacaagacag ttgagcgcaa atgttgtgtc     720
gagtgcccac cgtgcccagc accacctgtg gcaggaccgt cagtcttcct cttcccccca     780
aaacccaagg acaccctcat gatctcccgg acccctgagg tcacgtgcgt ggtggtggac     840
gtgagccacg aagacccccga ggtccagttc aactggtacg tggacggcgt ggaggtgcat     900
aatgccaaga caaagccacg ggaggagcag ttcaacagca cgttccgtgt ggtcagcgtc     960
ctcaccgttg tgcaccagga ctggctgaac ggcaaggagt acaagtgcaa ggtctccaac    1020
aaaggcctcc cagcccccat cgagaaaacc atctccaaaa ccaaagggca gccccgagaa    1080
ccacaggtgt acaccctgcc cccatcccgg gaggagatga ccaagaacca ggtcagcctg    1140
acctgcctgg tcaaaggctt ctaccccagc gacatcgccg tggagtggga gagcaatggg    1200
cagccggaga acaactacaa gaccacacct cccatgctgg actccgacgg ctccttcttc    1260
ctctacagca agctcaccgt ggacaagagc aggtggcagc aggggaacgt cttctcatgc    1320
tccgtgatgc atgaggctct gcacaaccac tacacgcaga gagcctctc cctgtctccg     1380
ggtaaatga                                                            1389
```

```
<210>  135
<211>  1410
<212>  DNA
<213>  Homo sapiens

<400>  135
atggcttggg tgtggacctt gccattcctg atggcagctg cccaaagcgt gcaggcccag      60
gtgcagctgg tcgagtctgg cggcggactg gtgcagcctg gcggcagcct gagactgagc     120
tgcgccgcca gcggcttcac cttcagcagc tacgtgatga ctgggtgcg gcaggcccct     180
```

FIGURE 9 Continued...

```
ggcaagggcc tggagtgggt gtccttcatc agcggcgaca gcagcaacac ctactacgcc      240
gacagcgtga agggccggtt caccatcagc cgggacaaca gcaagaacac cctgtacctg      300
cagatgaaca gcctgcgggc cgaggacacc gccgtgtact actgcgcccg gaccttcatg      360
cacggccacc tgggcggagg actgagcatg gatttctggg gccagggcac cctggtcacc      420
gtctcctcag cttccaccaa gggcccatcc gtcttccccc tggcgccctg ctccaggagc      480
acctccgaga gcacagcggc cctgggctgc ctggtcaagg actacttccc cgaaccggtg      540
acggtgtcgt ggaactcagg cgctctgacc agcggcgtgc acaccttccc agctgtccta      600
cagtcctcag gactctactc cctcagcagc gtggtgacag tgccctccag caacttcggc      660
acccagacct acacctgcaa cgtagatcac aagcccagca acaccaaggt ggacaagaca      720
gttgagcgca aatgttgtgt cgagtgccca ccgtgcccag caccacctgt ggcaggaccg      780
tcagtcttcc tcttccccc aaaacccaag gacaccctca tgatctcccg gacccctgag      840
gtcacgtgcg tggtggtgga cgtgagccac gaagaccccg aggtccagtt caactggtac      900
gtggacggcg tggaggtgca taatgccaag acaaagccac gggaggagca gttcaacagc      960
acgttccgtg tggtcagcgt cctcaccgtt gtgcaccagg actggctgaa cggcaaggag     1020
tacaagtgca aggtctccaa caaaggcctc ccagccccca tcgagaaaac catctccaaa     1080 accaagggc agccccgaga accacaggtg tacaccctgc ccccatcccg ggaggagatg     1140
accaagaacc aggtcagcct gacctgcctg gtcaaaggct tctacccag cgacatcgcc     1200 gtggagtggg agagcaatgg gcagccggag aacaactaca agaccacacc tcccatgctg     1260
gactccgacg gctccttctt cctctacagc aagctcaccg tggacaagag caggtggcag     1320
caggggaacg tcttctcatg ctccgtgatg catgaggctc tgcacaacca ctacacgcag     1380
aagagcctct ccctgtctcc gggtaaatga                                      1410
```

```
<210>  136
<211>  1389
<212>  DNA
<213>  Homo sapiens

<400>  136
atggcttggg tgtggacctt gccattcctg atggcagctg cccaaggtgt ccaggcccag       60
gtgcagctgg tcgagagcgg cggagggctg gtgcagcctg gcggcagcct gagactgagc      120
tgcgccgcca gcggcttcac cttcagaagc cactggctgt cctgggtgcg gcaggcccct      180
ggcaagggcc tggaatgggt gtccaacatc aactacgacg gcagcagcac ctactacgcc      240
gacagcgtga agggccggtt caccatcagc cgggacaaca gcaagaacac cctgtacctg      300
cagatgaaca gcctgcgggc cgaggacacc gccgtgtact actgcgccag ggacacctac      360
```

FIGURE 9 Continued...

```
ctgcacttcg actactgggg ccagggcacc ctggtcaccg tctcctcagc ttccaccaag    420
ggcccatccg tcttcccct ggcgccctgc tccaggagca cctccgagag cacagcggcc    480
ctgggctgcc tggtcaagga ctacttcccc gaaccggtga cggtgtcgtg gaactcaggc    540
gctctgacca gcggcgtgca caccttccca gctgtcctac agtcctcagg actctactcc    600
ctcagcagcg tggtgacagt gccctccagc aacttcggca cccagaccta cacctgcaac    660
gtagatcaca agcccagcaa caccaaggtg gacaagacag ttgagcgcaa atgttgtgtc    720
gagtgcccac cgtgcccagc accacctgtg gcaggaccgt cagtcttcct cttccccca    780
aaacccaagg acaccctcat gatctcccgg acccctgagg tcacgtgcgt ggtggtggac    840
gtgagccacg aagacccga ggtccagttc aactggtacg tggacggcgt ggaggtgcat    900
aatgccaaga caaagccacg ggaggagcag ttcaacagca cgttccgtgt ggtcagcgtc    960
ctcaccgttg tgcaccagga ctggctgaac ggcaaggagt acaagtgcaa ggtctccaac   1020
aaaggcctcc cagcccccat cgagaaaacc atctccaaaa ccaaagggca gccccgagaa   1080
ccacaggtgt acaccctgcc cccatcccgg gaggagatga ccaagaacca ggtcagcctg   1140
acctgcctgg tcaaaggctt ctaccccagc gacatcgccg tggagtggga gagcaatggg   1200
cagccggaga caactacaa gaccacacct cccatgctgg actccgacgg ctccttcttc   1260
ctctacagca agctcaccgt ggacaagagc aggtggcagc aggggaacgt cttctcatgc   1320
tccgtgatgc atgaggctct gcacaaccac tacacgcaga agagcctctc cctgtctccg   1380
ggtaaatga                                                           1389
```

```
<210>  137
<211>  1386
<212>  DNA
<213>  Homo sapiens

<400>  137
atggcttggg tgtggacctt gccattcctg atggcagctg cccaaagtgt ccaggcccag     60
gtgcagctgg tcgagagcgg cggagggctg gtgcagcctg gcggcagcct gagactgagc    120
tgcgccgcca gcggcttcac cttcagaagc cactggctgt cctgggtgcg gcaggcccct    180
ggcaagggcc tggaatgggt gtccgtgacc ggcgtgcacg gcgacaccta ctacgccgac    240
agcgtgaagg gccggttcac catcagccgg gacaacagca gaacaccct gtacctgcag    300
atgaacagcc tgcgggccga ggacaccgcc gtgtactact gcgccaggga cacctacctg    360
cacttcgact actggggcca gggcaccctg gtcaccgtct cctcagcttc caccaagggc    420
ccatccgtct tccccctggc gccctgctcc aggagcacct ccgagagcac agcggccctg    480
ggctgcctgg tcaaggacta cttccccgaa ccggtgacgg tgtcgtggaa ctcaggcgct    540
```

FIGURE 9 Continued...

```
ctgaccagcg gcgtgcacac cttcccagct gtcctacagt cctcaggact ctactccctc    600
agcagcgtgg tgacagtgcc ctccagcaac ttcggcaccc agacctacac ctgcaacgta    660
gatcacaagc ccagcaacac caaggtggac aagacagttg agcgcaaatg ttgtgtcgag    720
tgcccaccgt gcccagcacc acctgtggca ggaccgtcag tcttcctctt ccccccaaaa    780
cccaaggaca ccctcatgat ctcccggacc cctgaggtca cgtgcgtggt ggtggacgtg    840
agccacgaag accccgaggt ccagttcaac tggtacgtgg acggcgtgga ggtgcataat    900
gccaagacaa agccacggga ggagcagttc aacagcacgt tccgtgtggt cagcgtcctc    960
accgttgtgc accaggactg gctgaacggc aaggagtaca agtgcaaggt ctccaacaaa   1020
ggcctcccag cccccatcga gaaaaccatc tccaaaacca agggcagcc ccgagaacca   1080
caggtgtaca ccctgccccc atcccgggag gagatgacca agaaccaggt cagcctgacc   1140
tgcctggtca aaggcttcta ccccagcgac atcgccgtgg agtgggagag caatgggcag   1200
ccggagaaca actacaagac cacacctccc atgctggact ccgacggctc cttcttcctc   1260
tacagcaagc tcaccgtgga caagagcagg tggcagcagg ggaacgtctt ctcatgctcc   1320
gtgatgcatg aggctctgca caaccactac acgcagaaga gcctctccct gtctccgggt   1380
aaatga                                                              1386

<210>   138
<211>   1386
<212>   DNA
<213>   Homo sapiens

<400>   138
atggcttggg tgtggacctt gccattcctg atggcagctg cccaaagtgt ccaggcccag     60
gtgcagctgg tcgagagcgg cggagggctg gtgcagcctg gcggcagcct gagactgagc    120
tgcgccgcca gcggcttcac cttcagaagc cactggctgt cctgggtgcg gcaggcccct    180
ggcaagggcc tggaatgggt gtccgtgatc ggcaactggg gcgacaccta ctacgccgac    240
agcgtgaagg gccggttcac catcagccgg gacaacagca gaaacaccct gtacctgcag    300
atgaacagcc tgcgggccga ggacaccgcc gtgtactact gcgccaggga cacctacctg    360
cacttcgact actggggcca gggcaccctg gtcaccgtct cctcagcttc caccaagggc    420
ccatccgtct tcccctggc gccctgctcc aggagcacct ccgagagcac agcggccctg    480
ggctgcctgg tcaaggacta cttccccgaa ccggtgacgg tgtcgtggaa ctcaggcgct    540
ctgaccagcg gcgtgcacac cttcccagct gtcctacagt cctcaggact ctactccctc    600
agcagcgtgg tgacagtgcc ctccagcaac ttcggcaccc agacctacac ctgcaacgta    660
gatcacaagc ccagcaacac caaggtggac aagacagttg agcgcaaatg ttgtgtcgag    720
```

FIGURE 9 Continued...

```
tgcccaccgt gcccagcacc acctgtggca ggaccgtcag tcttcctctt ccccccaaaa      780
cccaaggaca ccctcatgat ctcccggacc cctgaggtca cgtgcgtggt ggtggacgtg      840
agccacgaag accccgaggt ccagttcaac tggtacgtgg acggcgtgga ggtgcataat      900
gccaagacaa agccacggga ggagcagttc aacagcacgt tccgtgtggt cagcgtcctc      960
accgttgtgc accaggactg gctgaacggc aaggagtaca agtgcaaggt ctccaacaaa     1020
ggcctcccag cccccatcga gaaaaccatc tccaaaacca agggcagcc cgagaacca      1080
caggtgtaca ccctgccccc atcccgggag gagatgacca agaaccaggt cagcctgacc     1140
tgcctggtca aaggcttcta ccccagcgac atcgccgtgg agtgggagag caatgggcag     1200
ccggagaaca actacaagac cacacctccc atgctggact ccgacggctc cttcttcctc     1260
tacagcaagc tcaccgtgga caagagcagg tggcagcagg ggaacgtctt ctcatgctcc     1320
gtgatgcatg aggctctgca caaccactac acgcagaaga gcctctccct gtctccgggt     1380
aaatga                                                                 1386
```

```
<210>  139
<211>  1386
<212>  DNA
<213>  Homo sapiens

<400>  139
atggcttggg tgtggacctt gccattcctg atggcagctg cccaaagtgt ccaggcccag       60
gtgcagctgg tcgagagcgg cggagggctg gtgcagcctg gcggcagcct gagactgagc      120
tgcgccgcca gcggcttcac cttcagaagc cactggctgt cctgggtgcg gcaggcccct      180
ggcaagggcc tggaatgggt gtccgtgacc acccaccagg gctacaccta ctacgccgac      240
agcgtgaagg gccggttcac catcagccgg gacaacagca gaacaccct gtacctgcag      300
atgaacagcc tgcgggccga ggacaccgcc gtgtactact gcgccaggga cacctacctg      360
cacttcgact actggggcca gggcaccctg gtcaccgtct cctcagcttc caccaagggc      420
ccatccgtct tccccctggc gccctgctcc aggagcacct ccgagagcac agcggccctg      480
ggctgcctgg tcaaggacta cttccccgaa ccggtgacgg tgtcgtggaa ctcaggcgct      540
ctgaccagcg gcgtgcacac cttcccagct gtcctacagt cctcaggact ctactccctc      600
agcagcgtgg tgacagtgcc ctccagcaac ttcggcaccc agacctacac ctgcaacgta      660
gatcacaagc ccagcaacac caaggtggac aagacagttg agcgcaaatg ttgtgtcgag      720
tgcccaccgt gcccagcacc acctgtggca ggaccgtcag tcttcctctt ccccccaaaa      780
cccaaggaca ccctcatgat ctcccggacc cctgaggtca cgtgcgtggt ggtggacgtg      840
agccacgaag accccgaggt ccagttcaac tggtacgtgg acggcgtgga ggtgcataat      900
```

FIGURE 9 Continued...

```
gccaagacaa agccacggga ggagcagttc aacagcacgt tccgtgtggt cagcgtcctc    960
accgttgtgc accaggactg gctgaacggc aaggagtaca agtgcaaggt ctccaacaaa   1020
ggcctcccag cccccatcga gaaaaccatc tccaaaacca agggcagcc ccgagaacca    1080
caggtgtaca ccctgccccc atcccgggag gagatgacca agaaccaggt cagcctgacc   1140
tgcctggtca aaggcttcta ccccagcgac atcgccgtgg agtgggagag caatgggcag   1200
ccggagaaca actacaagac cacacctccc atgctggact ccgacggctc cttcttcctc   1260
tacagcaagc tcaccgtgga caagagcagg tggcagcagg ggaacgtctt ctcatgctcc   1320
gtgatgcatg aggctctgca caaccactac acgcagaaga gcctctccct gtctccgggt   1380
aaatga                                                              1386

<210> 140
<211> 1386
<212> DNA
<213> Homo sapiens

<400> 140
atggcttggg tgtggacctt gccattcctg atggcagctg cccaaagtgt ccaggcccag     60
gtgcagctgg tcgagagcgg cggagggctg gtgcagcctg gcggcagcct gagactgagc    120
tgcgccgcca gcggcttcac cttcagaagc cactggctgt cctgggtgcg gcaggcccct    180
ggcaagggcc tggaatgggt gtccgccacc aacagatacg gctacaccta ctacgccgac    240
agcgtgaagg gccggttcac catcagccgg gacaacagca gaaccaccct gtacctgcag    300
atgaacagcc tgcgggccga ggacaccgcc gtgtactact gcgccaggga cacctacctg    360
cacttcgact actggggcca gggcaccctg gtcaccgtct cctcagcttc caccaagggc    420
ccatccgtct tccccctggc gccctgctcc aggagcacct ccgagagcac agcggccctg    480
ggctgcctgg tcaaggacta cttccccgaa ccggtgacgg tgtcgtggaa ctcaggcgct    540
ctgaccagcg gcgtgcacac cttcccagct gtcctacagt cctcaggact ctactccctc    600
agcagcgtgg tgacagtgcc ctccagcaac ttcggcaccc agacctacac ctgcaacgta    660
gatcacaagc ccagcaacac caaggtggac aagacagttg agcgcaaatg ttgtgtcgag    720
tgcccaccgt gcccagcacc acctgtggca ggaccgtcag tcttcctctt ccccccaaaa    780
cccaaggaca ccctcatgat ctcccggacc cctgaggtca cgtgcgtggt ggtggacgtg    840
agccacgaag accccgaggt ccagttcaac tggtacgtgg acggcgtgga ggtgcataat    900
gccaagacaa agccacggga ggagcagttc aacagcacgt tccgtgtggt cagcgtcctc    960
accgttgtgc accaggactg gctgaacggc aaggagtaca agtgcaaggt ctccaacaaa   1020
ggcctcccag cccccatcga gaaaaccatc tccaaaacca agggcagcc ccgagaacca    1080
```

FIGURE 9 Continued...

```
caggtgtaca ccctgccccc atcccgggag gagatgacca agaaccaggt cagcctgacc    1140
tgcctggtca aaggcttcta ccccagcgac atcgccgtgg agtgggagag caatgggcag    1200
ccggagaaca actacaagac cacacctccc atgctggact ccgacggctc cttcttcctc    1260
tacagcaagc tcaccgtgga caagagcagg tggcagcagg ggaacgtctt ctcatgctcc    1320
gtgatgcatg aggctctgca caaccactac acgcagaaga gcctctccct gtctccgggt    1380
aaatga                                                              1386

<210>  141
<211>  1389
<212>  DNA
<213>  Homo sapiens

<400>  141
atggcttggg tgtggacctt gccattcctg atggcagctg cccaaggtgt ccaggcccag      60
gtgcagctgg tcgagagcgg cggagggctg gtgcagcctg gcggcagcct gagactgagc     120
tgcgccgcca gcggcttcac cttcagaagc cactggctgt cctgggtgcg gcaggcccct     180
ggcaagggcc tggaatgggt gtccaacatc aactacgacg gcagcagcac ctactacgcc     240
gacagcgtga agggccggtt caccatcagc cgggacaaca gcaagaacac cctgtacctg     300
cagatgaaca gcctgcgggc cgaggacacc gccgtgtact actgcgccag ggacacctac     360
ctgcacttcg actactgggg ccagggcacc ctggtcaccg tctcctcagc ttccaccaag     420
ggcccatccg tcttccccct ggcgccctgc tccaggagca cctccgagag cacagcggcc     480
ctgggctgcc tggtcaagga ctacttcccc gaaccggtga cggtgtcgtg gaactcaggc     540
gctctgacca gcggcgtgca caccttccca gctgtcctac agtcctcagg actctactcc     600
ctcagcagcg tggtgacagt gccctccagc aacttcggca cccagaccta cacctgcaac     660
gtagatcaca agcccagcaa caccaaggtg gacaagacag ttgagcgcaa atgttgtgtc     720
gagtgcccac cgtgcccagc caccctgtg gcaggaccgt cagtcttcct cttcccccca     780
aaacccaagg acaccctcat gatctcccgg acccctgagg tcacgtgcgt ggtggtggac     840
gtgagccacg aagaccccga ggtccagttc aactggtacg tggacggcgt ggaggtgcat     900
aatgccaaga caaagccacg ggaggagcag ttcaacagca cgttccgtgt ggtcagcgtc     960
ctcaccgttg tgcaccagga ctggctgaac ggcaaggagt acaagtgcaa ggtctccaac    1020
aaaggcctcc cagcccccat cgagaaaacc atctccaaaa ccaaagggca gccccgagaa    1080
ccacaggtgt acaccctgcc cccatcccgg gaggagatga ccaagaacca ggtcagcctg    1140
acctgcctgg tcaaaggctt ctaccccagc gacatcgccg tggagtggga gagcaatggg    1200
cagccggaga acaactacaa gaccacacct cccatgctgg actccgacgg ctccttcttc    1260
```

FIGURE 9 Continued...

```
ctctacagca agctcaccgt ggacaagagc aggtggcagc aggggaacgt cttctcatgc    1320
tccgtgatgc atgaggctct gcacaaccac tacacgcaga agagcctctc cctgtctccg    1380
ggtaaatga                                                            1389

<210>  142
<211>  1386
<212>  DNA
<213>  Homo sapiens

<400>  142
atggcttggg tgtggacctt gccattcctg atggcagctg cccaaagtgt ccaggcccag      60
gtgcagctgg tcgagagcgg cggagggctg gtgcagcctg gcggcagcct gagactgagc     120
tgcgccgcca gcggcttcac cttcagaagc cactggctgt cctgggtgcg gcaggcccct     180
ggcaagggcc tggaatgggt gtccgtgatc accccctacg gcgacaccta ctacgccgac     240
agcgtgaagg gccggttcac catcagccgg gacaacagca gaacaccct gtacctgcag     300
atgaacagcc tgcgggccga ggacaccgcc gtgtactact gcgccaggga cacctacctg     360
cacttcgact actggggcca gggcaccctg gtcaccgtct cctcagcttc caccaagggc     420
ccatccgtct tccccctggc gccctgctcc aggagcacct ccgagagcac agcggccctg     480
ggctgcctgg tcaaggacta cttccccgaa ccggtgacgg tgtcgtggaa ctcaggcgct     540
ctgaccagcg gcgtgcacac cttcccagct gtcctacagt cctcaggact ctactccctc     600
agcagcgtgg tgacagtgcc ctccagcaac ttcggcaccc agacctacac ctgcaacgta     660
gatcacaagc ccagcaacac caaggtggac aagacagttg agcgcaaatg ttgtgtcgag     720
tgcccaccgt gcccagcacc acctgtggca ggaccgtcag tcttcctctt ccccccaaaa     780
cccaaggaca ccctcatgat ctcccggacc cctgaggtca cgtgcgtggt ggtggacgtg     840
agccacgaag accccgaggt ccagttcaac tggtacgtgg acggcgtgga ggtgcataat     900
gccaagacaa agccacggga ggagcagttc aacagcacgt tccgtgtggt cagcgtcctc     960
accgttgtgc accaggactg gctgaacggc aaggagtaca agtgcaaggt ctccaacaaa    1020
ggcctcccag cccccatcga gaaaaccatc tccaaaacca agggcagcc ccgagaacca    1080
caggtgtaca ccctgccccc atcccgggag gagatgacca gaaccaggt cagcctgacc    1140
tgcctggtca aaggcttcta ccccagcgac atcgccgtgg agtgggagag caatgggcag    1200
ccggagaaca actacaagac cacacctccc atgctggact ccgacggctc cttcttcctc    1260
tacagcaagc tcaccgtgga caagagcagg tggcagcagg gaacgtctt ctcatgctcc    1320
gtgatgcatg aggctctgca caaccactac acgcagaaga gcctctccct gtctccgggt    1380
aaatga                                                              1386
```

FIGURE 9 Continued...

```
<210>  143
<211>  1386
<212>  DNA
<213>  Homo sapiens

<400>  143
atggcttggg tgtggacctt gccattcctg atggcagctg cccaaagtgt ccaggcccag      60
gtgcagctgg tcgagagcgg cggagggctg gtgcagcctg gcggcagcct gagactgagc     120
tgcgccgcca gcggcttcac cttcagaagc cactggctgt cctgggtgcg gcaggcccct     180
ggcaagggcc tggaatgggt gtccgtgatc accccctacg cgacaccta ctacgccgac     240
agcgtgaagg gccggttcac catcagccgg acaacagca agaacaccct gtacctgcag      300
atgaacagcc tgcgggccga ggacaccgcc gtgtactact gcgccaggga cacctacctg     360
cacttcgact actggggcca gggcaccctg gtcaccgtct cctcagcttc caccaagggc     420
ccatccgtct tccccctggc gccctgctcc aggagcacct ccgagagcac agcggccctg     480
ggctgcctgg tcaaggacta cttcccgaa ccggtgacgg tgtcgtggaa ctcaggcgct      540
ctgaccagcg gcgtgcacac cttcccagct gtcctacagt cctcaggact ctactccctc     600
agcagcgtgg tgacagtgcc ctccagcaac ttcggcaccc agacctacac ctgcaacgta     660
gatcacaagc ccagcaacac caaggtggac aagacagttg agcgcaaatg ttgtgtcgag     720
tgcccaccgt gcccagcacc acctgtggca ggaccgtcag tcttcctctt cccccaaaa      780
cccaaggaca ccctcatgat ctcccggacc cctgaggtca cgtgcgtggt ggtggacgtg     840
agccacgaag accccgaggt ccagttcaac tggtacgtgg acggcgtgga ggtgcataat     900
gccaagacaa agccacggga ggagcagttc aacagcacgt tccgtgtggt cagcgtcctc     960
accgttgtgc accaggactg gctgaacggc aaggagtaca agtgcaaggt ctccaacaaa    1020
ggcctcccag cccccatcga gaaaaccatc tccaaaacca agggcagcc cgagaacca     1080
caggtgtaca ccctgccccc atcccgggag gagatgacca gaaccaggt cagcctgacc     1140
tgcctggtca aaggcttcta ccccagcgac atcgccgtgg agtgggagag caatgggcag    1200
ccggagaaca actacaagac cacacctccc atgctggact ccgacggctc cttcttcctc    1260
tacagcaagc tcaccgtgga caagagcagg tggcagcagg gaacgtctt ctcatgctcc     1320
gtgatgcatg aggctctgca caaccactac acgcagaaga gcctctccct gtctccgggt    1380
aaatga                                                               1386

<210>  144
<211>  393
<212>  DNA
<213>  Homo sapiens
```

FIGURE 9 Continued...

```
<400> 144
atgaaaaaga cagctatcgc gattgcagtg gcactggctg gtttcgctac cgtagcgcag      60
gccgatatcg aactgaccca gccgccttca gtgagcgttg caccaggtca gaccgcgcgt     120
atctcgtgta gcggcgataa tattggttct ttttatgttc attggtacca gcagaaaccc     180
gggcaggcgc cagttcttgt gatttatgat gataataatc gtccctcagg catcccggaa     240
cgctttagcg gatccaacag cggcaacacc gcgaccctga ccattagcgg cactcaggcg     300
gaagacgaag cggattatta ttgcggttct tgggctggtt cttctggttc ttatgtgttt     360
ggcggccgca cgaagttaac cgttcttggc cag                                  393

<210>    145
<211>    714
<212>    DNA
<213>    Homo sapiens

<400> 145
atgagtgtgc tcactcaggt cctggcgttg ctgctgctgt ggcttacagg tacgcgttgc      60
gacatcgccc tgacccagcc cgccagcgtg agcggcagcc ctggccagag catcaccatc     120
agctgcaccg gcaccagcag cgacgtgggc gacatcaacg acgtgagctg gtatcagcag     180
caccccggca aggcccccaa gctgatgatc tacgacgtga acaaccggcc cagcggcgtg     240
agcaaccggt tcagcggcag caagagcggc aacaccgcca gcctgaccat cagcggcctc     300
caggccgagg acgaggccga ctactactgc agcagctacg gcgagagcct gaccagctac     360
gtgtttggcg gcggaaccaa gcttaccgtc ctaggtcagc ccaaggctgc cccctcggtc     420
actctgttcc cgccctcctc tgaggagctt caagccaaca aggccacact ggtgtgtctc     480
ataagtgact tctaccaggg agccgtgaca gtggcctgga aggcagatag cagccccgtc     540
aaggcgggag tggagacaac cacacccctc aaacaaagca caacaagta cgcggccagc     600 agctatctga gcctgacgcc tgagcagtgg aagtcccaca aagctacag ctgccaggtc     660 acgcatgaag ggagcaccgt ggaaaagaca gtggcccta cagaatgttc atag           714

<210>    146
<211>    705
<212>    DNA
<213>    Homo sapiens

<400> 146
atgagtgtgc tcactcaggt cctggcgttg ctgctgctgt ggcttacagg tacgcgttgc      60
gacatcgagc tgacccagcc ccccagcgtg agcgtggccc tggccagac cgcccggatc     120 agctgcagcg gcgacaacat cggcagcttc tacgtgcact ggtatcagca gaagcccggc     180 caggccccg tgctggtgat ctacgacgac aacaaccggc cagcggcat ccccgagcgg     240
```

FIGURE 9 Continued...

```
ttcagcggca gcaacagcgg caacaccgcc accctgacca tcagcggcac ccaggccgag    300
gacgaggccg actactactg cgccagctgg accggcgtgg agcccgacta cgtgtttggc    360
ggcggaacaa agcttaccgt cctaggtcag cccaaggctg ccccctcggt cactctgttc    420
ccgccctcct ctgaggagct tcaagccaac aaggccacac tggtgtgtct cataagtgac    480
ttctacccgg gagccgtgac agtggcctgg aaggcagata gcagccccgt caaggcggga    540
gtggagacaa ccacaccctc caaacaaagc aacaacaagt acgcggccag cagctatctg    600
agcctgacgc ctgagcagtg gaagtcccac agaagctaca gctgccaggt cacgcatgaa    660
gggagcaccg tggaaaagac agtggcccct acagaatgtt catag                   705
```

```
<210>   147
<211>   714
<212>   DNA
<213>   Homo sapiens

<400>   147
atgagtgtgc tcactcaggt cctggcgttg ctgctgctgt ggcttacagg tacgcgttgc    60
gacatcgccc tgacccagcc cgccagcgtg agcggcagcc ctggccagag catcaccatc    120
agctgcaccg gcaccagcag cgacgtgggc gacatcaacg acgtgagctg gtatcagcag    180
cacccggca aggcccccaa gctgatgatc tacgacgtga acaaccggcc cagcggcgtg    240
agcaaccggt tcagcggcag caagagcggc aacaccgcca gctgaccat cagcggcctc    300
caggccgagg acgaggccga ctactactgc cagagctacg ccggcagcta cctgagcgag    360
gtgttcggcg gagggaccaa gcttaccgtc ctaggtcagc ccaaggctgc cccctcggtc    420
actctgttcc cgccctcctc tgaggagctt caagccaaca aggccacact ggtgtgtctc    480
ataagtgact tctacccggg agccgtgaca gtggcctgga aggcagatag cagccccgtc    540
aaggcgggag tggagacaac cacaccctcc aaacaaagca acaacaagta cgcggccagc    600
agctatctga gcctgacgcc tgagcagtgg aagtcccaca gaagctacag ctgccaggtc    660
acgcatgaag ggagcaccgt ggaaaagaca gtggccccta cagaatgttc atag         714
```

```
<210>   148
<211>   714
<212>   DNA
<213>   Homo sapiens

<400>   148
atgagtgtgc tcactcaggt cctggcgttg ctgctgctgt ggcttacagg tacgcgttgc    60
gacatcgccc tgacccagcc cgccagcgtg agcggcagcc ctggccagag catcaccatc    120
agctgcaccg gcaccagcag cgacgtgggc gacatcaacg acgtgagctg gtatcagcag    180
cacccggca aggcccccaa gctgatgatc tacgacgtga acaaccggcc cagcggcgtg    240
```

FIGURE 9 Continued...

```
agcaaccggt tcagcggcag caagagcggc aacaccgcca gcctgaccat cagcggcctc    300
caggccgagg acgaggccga ctactactgc agcagctacg gcgagagcct gaccagctac    360
gtgtttggcg gcggaaccaa gcttaccgtc ctaggtcagc ccaaggctgc cccctcggtc    420
actctgttcc cgccctcctc tgaggagctt caagccaaca aggccacact ggtgtgtctc    480
ataagtgact tctacccggg agccgtgaca gtggcctgga aggcagatag cagcccgtc     540
aaggcgggag tggagacaac cacaccctcc aaacaaagca acaacaagta cgcggccagc    600
agctatctga gcctgacgcc tgagcagtgg aagtcccaca gaagctacag ctgccaggtc    660
acgcatgaag ggagcaccgt ggaaaagaca gtggccccta cagaatgttc atag          714

<210> 149
<211> 714
<212> DNA
<213> Homo sapiens

<400> 149
atgagtgtgc tcactcaggt cctggcgttg ctgctgctgt ggcttacagg tacgcgttgc     60
gacatcgccc tgacccagcc cgccagcgtg agcggcagcc ctggccagag catcaccatc    120
agctgcaccg gcaccagcag cgacgtgggc gacatcaacg acgtgagctg gtatcagcag    180
cacccccggca aggcccccaa gctgatgatc tacgacgtga caaccggcc cagcggcgtg    240
agcaaccggt tcagcggcag caagagcggc aacaccgcca gcctgaccat cagcggcctc    300
caggccgagg acgaggccga ctactactgc agcagctacg gcgagagcct gaccagctac    360
gtgtttggcg gcggaaccaa gcttaccgtc ctaggtcagc ccaaggctgc cccctcggtc    420
actctgttcc cgccctcctc tgaggagctt caagccaaca aggccacact ggtgtgtctc    480
ataagtgact tctacccggg agccgtgaca gtggcctgga aggcagatag cagcccgtc     540
aaggcgggag tggagacaac cacaccctcc aaacaaagca acaacaagta cgcggccagc    600
agctatctga gcctgacgcc tgagcagtgg aagtcccaca gaagctacag ctgccaggtc    660
acgcatgaag ggagcaccgt ggaaaagaca gtggccccta cagaatgttc atag          714

<210> 150
<211> 714
<212> DNA
<213> Homo sapiens

<400> 150
atgagtgtgc tcactcaggt cctggcgttg ctgctgctgt ggcttacagg tacgcgttgc     60
gacatcgccc tgacccagcc cgccagcgtg agcggcagcc ctggccagag catcaccatc    120
agctgcaccg gcaccagcag cgacgtgggc gacatcaacg acgtgagctg gtatcagcag    180
```

FIGURE 9 Continued...

```
cacccggca  aggccccaa   gctgatgatc  tacgacgtga  acaaccggcc  cagcggcgtg    240
agcaaccggt  tcagcggcag  caagagcggc  aacaccgcca  gcctgaccat  cagcggcctc    300
caggccgagg  acgaggccga  ctactactgc  agcagctacg  gcgagagcct  gaccagctac    360
gtgtttggcg  gcggaaccaa  gcttaccgtc  ctaggtcagc  ccaaggctgc  ccctcggtc     420 actctgttcc  cgccctcctc  tgaggagctt  caagccaaca  aggccacact  ggtgtgtctc    480
ataagtgact  tctacccggg  agccgtgaca  gtggcctgga  aggcagatag  cagccccgtc    540
aaggcgggag  tggagacaac  cacaccctcc  aaacaaagca  acaacaagta  cgcggccagc    600
agctatctga  gcctgacgcc  tgagcagtgg  aagtcccaca  gaagctacag  ctgccaggtc    660
acgcatgaag  ggagcaccgt  ggaaaagaca  gtggcccta   cagaatgttc  atag           714
```

```
<210> 151
<211> 714
<212> DNA
<213> Homo sapiens

<400> 151
atgagtgtgc  tcactcaggt  cctggcgttg  ctgctgctgt  ggcttacagg  tacgcgttgc     60
gacatcgccc  tgacccagcc  cgccagcgtg  agcggcagcc  ctggccagag  catcaccatc    120
agctgcaccg  gcaccagcag  cgacgtgggc  gacatcaacg  acgtgagctg  gtatcagcag    180 cacccggca  aggccccaa   gctgatgatc  tacgacgtga  acaaccggcc  cagcggcgtg    240
agcaaccggt  tcagcggcag  caagagcggc  aacaccgcca  gcctgaccat  cagcggcctc    300
caggccgagg  acgaggccga  ctactactgc  agcagctacg  gcgagagcct  gaccagctac    360
gtgtttggcg  gcggaaccaa  gcttaccgtc  ctaggtcagc  ccaaggctgc  ccctcggtc     420 actctgttcc  cgccctcctc  tgaggagctt  caagccaaca  aggccacact  ggtgtgtctc    480
ataagtgact  tctacccggg  agccgtgaca  gtggcctgga  aggcagatag  cagccccgtc    540
aaggcgggag  tggagacaac  cacaccctcc  aaacaaagca  acaacaagta  cgcggccagc    600
agctatctga  gcctgacgcc  tgagcagtgg  aagtcccaca  gaagctacag  ctgccaggtc    660
acgcatgaag  ggagcaccgt  ggaaaagaca  gtggcccta   cagaatgttc  atag           714
```

```
<210> 152
<211> 714
<212> DNA
<213> Homo sapiens

<400> 152
atgagtgtgc  tcactcaggt  cctggcgttg  ctgctgctgt  ggcttacagg  tacgcgttgc     60
gacatcgccc  tgacccagcc  cgccagcgtg  agcggcagcc  ctggccagag  catcaccatc    120
agctgcaccg  gcaccagcag  cgacgtgggc  gacatcaacg  acgtgagctg  gtatcagcag    180
```

FIGURE 9 Continued...

```
cacccggca   aggcccccaa   gctgatgatc   tacgacgtga   acaaccggcc   cagcggcgtg    240
agcaaccggt  tcagcggcag   caagagcggc   aacaccgcca   gcctgaccat   cagcggcctc    300
caggccgagg  acgaggccga   ctactactgc   agcacctacg   acggccctgg   cctgagcgag    360
gtgttcggcg  gagggaccaa   gcttaccgtc   ctaggtcagc   ccaaggctgc   cccctcggtc    420
actctgttcc  cgccctcctc   tgaggagctt   caagccaaca   aggccacact   ggtgtgtctc    480
ataagtgact  tctacccggg   agccgtgaca   gtggcctgga   aggcagatag   cagccccgtc    540
aaggcgggag  tggagacaac   cacaccctcc   aaacaaagca   acaacaagta   cgcggccagc    600
agctatctga  gcctgacgcc   tgagcagtgg   aagtcccaca   gaagctacag   ctgccaggtc    660
acgcatgaag  ggagcaccgt   ggaaaagaca   gtggcccta    cagaatgttc   atag          714
```

<210> 153
<211> 714
<212> DNA
<213> Homo sapiens

<400> 153
```
atgagtgtgc  tcactcaggt   cctggcgttg   ctgctgctgt   ggcttacagg   tacgcgttgc    60
gacatcgccc  tgacccagcc   cgccagcgtg   agcggcagcc   ctggccagag   catcaccatc   120
agctgcaccg  gcaccagcag   cgacgtgggc   gacatcaacg   acgtgagctg   gtatcagcag   180 cacccggca   aggcccccaa   gctgatgatc   tacgacgtga   acaaccggcc   cagcggcgtg   240
agcaaccggt  tcagcggcag   caagagcggc   aacaccgcca   gcctgaccat   cagcggcctc   300
caggccgagg  acgaggccga   ctactactgc   agcacctacg   acggccctgg   cctgagcgag   360
gtgttcggcg  gagggaccaa   gcttaccgtc   ctaggtcagc   ccaaggctgc   cccctcggtc   420
actctgttcc  cgccctcctc   tgaggagctt   caagccaaca   aggccacact   ggtgtgtctc   480
ataagtgact  tctacccggg   agccgtgaca   gtggcctgga   aggcagatag   cagccccgtc   540
aaggcgggag  tggagacaac   cacaccctcc   aaacaaagca   acaacaagta   cgcggccagc   600
agctatctga  gcctgacgcc   tgagcagtgg   aagtcccaca   gaagctacag   ctgccaggtc   660
acgcatgaag  ggagcaccgt   ggaaaagaca   gtggcccta    cagaatgttc   atag         714
```

<210> 154
<211> 714
<212> DNA
<213> Homo sapiens

<400> 154
```
atgagtgtgc  tcactcaggt   cctggcgttg   ctgctgctgt   ggcttacagg   tacgcgttgc    60
gacatcgccc  tgacccagcc   cgccagcgtg   agcggcagcc   ctggccagag   catcaccatc   120
```

FIGURE 9 Continued...

```
agctgcaccg gcaccagcag cgacgtgggc gacatcaacg acgtgagctg gtatcagcag    180
caccccggca aggcccccaa gctgatgatc tacgacgtga caaccggcc cagcggcgtg    240 agcaaccggt tcagcggcag caagagcggc aacaccgcca gcctgaccat cagcggcctc    300
caggccgagg acgaggccga ctactactgc agcacctacg acggccctgg cctgagcgag    360
gtgttcggcg gagggaccaa gcttaccgtc ctaggtcagc ccaaggctgc ccctcggtc    420 actctgttcc cgccctcctc tgaggagctt caagccaaca aggccacact ggtgtgtctc    480
ataagtgact tctacccggg agccgtgaca gtggcctgga aggcagatag cagccccgtc    540
aaggcgggag tggagacaac cacaccctcc aaacaaagca caacaagta cgcggccagc    600 agctatctga gcctgacgcc tgagcagtgg aagtcccaca gaagctacag ctgccaggtc    660
acgcatgaag ggagcaccgt ggaaaagaca gtggccccta cagaatgttc atag         714
```

```
<210>  155
<211>  213
<212>  PRT
<213>  homo sapiens

<400>  155

Met Gln Leu Pro Leu Ala Leu Cys Leu Val Cys Leu Leu Val His Thr
1               5                   10                  15

Ala Phe Arg Val Val Glu Gly Gln Gly Trp Gln Ala Phe Lys Asn Asp
                20                  25                  30

Ala Thr Glu Ile Ile Pro Glu Leu Gly Glu Tyr Pro Glu Pro Pro Pro
                35                  40                  45

Glu Leu Glu Asn Asn Lys Thr Met Asn Arg Ala Glu Asn Gly Gly Arg
            50                  55                  60

Pro Pro His His Pro Phe Glu Thr Lys Asp Val Ser Glu Tyr Ser Cys
65                  70                  75                  80

Arg Glu Leu His Phe Thr Arg Tyr Val Thr Asp Gly Pro Cys Arg Ser
                85                  90                  95

Ala Lys Pro Val Thr Glu Leu Val Cys Ser Gly Gln Cys Gly Pro Ala
                100                 105                 110

Arg Leu Leu Pro Asn Ala Ile Gly Arg Gly Lys Trp Trp Arg Pro Ser
                115                 120                 125

Gly Pro Asp Phe Arg Cys Ile Pro Asp Arg Tyr Arg Ala Gln Arg Val
```

Gln Leu Leu Cys Pro Gly Gly Glu Ala Pro Arg Ala Arg Lys Val Arg
145                 150                 155                 160

Leu Val Ala Ser Cys Lys Cys Lys Arg Leu Thr Arg Phe His Asn Gln
                165                 170                 175

Ser Glu Leu Lys Asp Phe Gly Thr Glu Ala Ala Arg Pro Gln Lys Gly
                180                 185                 190

Arg Lys Pro Arg Pro Arg Ala Arg Ser Ala Lys Ala Asn Gln Ala Glu
            195                 200                 205

Leu Glu Asn Ala Tyr
        210

<210>   156
<211>   14
<212>   PRT
<213>   Homo sapiens

<400>   156

Ala Arg Leu Leu Asn Ala Ile Gly Arg Gly Lys Trp Trp Arg
1               5                   10

<210>   157
<211>   15
<212>   PRT
<213>   Homo sapiens

<400>   157

Arg Leu Val Ala Ser Cys Lys Cys Lys Arg Leu Thr Arg Phe His
1               5                   10                  15

<210>   158
<211>   13
<212>   PRT
<213>   Artificial

<220>
<223>   Protein linker sequence

<400>   158

Gly Gly Gly Ser Gly Gly Gly Gly Ser Gly Gly Gly Gly
1               5                   10

<210>   159
<211>   19
<212>   PRT
```

FIGURE 9 Continued...

```
<213>  Artificial

<220>
<223>  Protein linker sequence

<400>  159

Gly Gly Gly Gly Ser Gly Gly Gly Gly Ser Gly Gly Gly Gly Ser Gly
1               5                   10                  15

Gly Gly Gly

<210>  160
<211>  21
<212>  DNA
<213>  Artificial

<220>
<223>  siRNA

<400>  160
taaattatca taaagtccta a                                              21

<210>  161
<211>  21
<212>  DNA
<213>  Artificial

<220>
<223>  siRNA

<400>  161
aggactttat gataatttat t                                              21

<210>  162
<211>  21
<212>  DNA
<213>  Artificial

<220>
<223>  siRNA

<400>  162
atagtggtta aataactcca g                                              21

<210>  163
<211>  21
<212>  DNA
<213>  Artificial

<220>
<223>  siRNA

<400>  163
ggagttattt aaccactatt t                                              21
```

FIGURE 9 Continued...

```
<210>  164
<211>  21
<212>  DNA
<213>  Artificial

<220>
<223>  siRNA

<400>  164
taaattctcg tgatgtgcca t                                              21

<210>  165
<211>  21
<212>  DNA
<213>  Artificial

<220>
<223>  siRNA

<400>  165
ggcacatcac gagaatttat t                                              21

<210>  166
<211>  21
<212>  DNA
<213>  Artificial

<220>
<223>  siRNA

<400>  166
tttcttatag cacagctggt t                                              21

<210>  167
<211>  21
<212>  DNA
<213>  Artificial

<220>
<223>  siRNA

<400>  167
ccagctgtgc tataagaaat t                                              21

<210>  168
<211>  21
<212>  DNA
<213>  Artificial

<220>
<223>  siRNA

<400>  168
tagacctttc catccacgct g                                              21
```

FIGURE 9 Continued...

```
<210>  169
<211>  21
<212>  DNA
<213>  Artificial

<220>
<223>  siRNA

<400>  169
gcgtggatgg aaaggtctat t                                              21

<210>  170
<211>  29
<212>  DNA
<213>  Artificial

<220>
<223>  RT-PCT primer

<400>  170
atgcagctcc cactggccct gtgtcttgt                                      29

<210>  171
<211>  30
<212>  DNA
<213>  Artificial

<220>
<223>  RT-PCR primer

<400>  171
aatcaggccg agctggagaa cgcctactag                                     30
```

FIGURE 10

```
SEQUENCE LISTING

<110>  Ablynx N.V.

<120>  Amino acid sequences directed against sclerostin and polypeptides
       comprising the same for the treatment of bone diseases and
       disorders

<130>  P09-013-PCT-1

<150>  US 61/178,679
<151>  2009-05-15

<160>  199

<170>  PatentIn version 3.5

<210>  1
<211>  102
<212>  PRT
<213>  Artificial Sequence

<220>
<223>  KERE-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  1

Glu Val Gln Leu Val Glu Ser Gly Gly Gly Leu Val Gln Pro Gly Gly
1               5                   10                  15

Ser Leu Arg Leu Ser Cys Ala Ala Ser Gly Ile Pro Phe Ser Xaa Xaa
                20                  25                  30

Xaa Xaa Xaa Trp Phe Arg Gln Ala Pro Gly Lys Gln Arg Asp Ser Val
            35                  40                  45

Ala Xaa Xaa Xaa Xaa Xaa Arg Phe Thr Ile Ser Arg Asp Asn Ala Lys
    50                  55                  60

Asn Thr Val Tyr Leu Gln Met Asn Ser Leu Lys Pro Glu Asp Thr Ala
65                  70                  75                  80
```

FIGURE 10 Continued...

```
Val Tyr Arg Cys Tyr Phe Xaa Xaa Xaa Xaa Xaa Trp Gly Gln Gly Thr
                85              90                  95

Gln Val Thr Val Ser Ser
            100

<210>  2
<211>  102
<212>  PRT
<213>  Artificial Sequence

<220>
<223>  KERE-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  2

Gln Val Lys Leu Glu Glu Ser Gly Gly Gly Leu Val Gln Ala Gly Gly
1               5                   10                  15

Ser Leu Arg Leu Ser Cys Val Gly Ser Gly Arg Thr Phe Ser Xaa Xaa
                20                  25                  30

Xaa Xaa Xaa Trp Phe Arg Leu Ala Pro Gly Lys Glu Arg Glu Phe Val
            35                  40                  45

Ala Xaa Xaa Xaa Xaa Xaa Arg Phe Thr Ile Ser Arg Asp Thr Ala Ser
        50                  55                  60

Asn Arg Gly Tyr Leu His Met Asn Asn Leu Thr Pro Glu Asp Thr Ala
65                  70                  75                  80

Val Tyr Tyr Cys Ala Ala Xaa Xaa Xaa Xaa Xaa Trp Gly Gln Gly Thr
                85                  90                  95

Gln Val Thr Val Ser Ser
            100
```

FIGURE 10 Continued...

```
<210>  3
<211>  102
<212>  PRT
<213>  Artificial Sequence

<220>
<223>  KERE-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  3
```

Ala Val Gln Leu Val Asp Ser Gly Gly Gly Leu Val Gln Ala Gly Asp
1               5                   10                  15

Ser Leu Lys Leu Ser Cys Ala Leu Thr Gly Gly Ala Phe Thr Xaa Xaa
            20                  25                  30

Xaa Xaa Xaa Trp Phe Arg Gln Thr Pro Gly Arg Glu Arg Glu Phe Val
        35                  40                  45

Ala Xaa Xaa Xaa Xaa Xaa Arg Phe Thr Ile Ser Arg Asp Asn Ala Lys
    50                  55                  60

Asn Met Val Tyr Leu Arg Met Asn Ser Leu Ile Pro Glu Asp Ala Ala
65                  70                  75                  80

Val Tyr Ser Cys Ala Ala Xaa Xaa Xaa Xaa Xaa Trp Gly Gln Gly Thr
            85                  90                  95

Leu Val Thr Val Ser Ser
            100

```
<210>  4
<211>  102
<212>  PRT
<213>  Artificial Sequence
```

FIGURE 10 Continued...

```
<220>
<223>   KERE-class Nanobody

<220>
<221>   misc_feature
<222>   (31)..(35)
<223>   CDR

<220>
<221>   misc_feature
<222>   (50)..(54)
<223>   CDR

<220>
<221>   misc_feature
<222>   (87)..(91)
<223>   CDR

<400>   4
```

Gln Val Gln Leu Val Glu Ser Gly Gly Gly Leu Val Glu Ala Gly Gly
1               5                   10                  15

Ser Leu Arg Leu Ser Cys Thr Ala Ser Glu Ser Pro Phe Arg Xaa Xaa
            20                  25                  30

Xaa Xaa Xaa Trp Phe Arg Gln Thr Ser Gly Gln Glu Arg Glu Phe Val
        35                  40                  45

Ala Xaa Xaa Xaa Xaa Xaa Arg Phe Thr Ile Ser Arg Asp Asp Ala Lys
    50                  55                  60

Asn Thr Val Trp Leu His Gly Ser Thr Leu Lys Pro Glu Asp Thr Ala
65                  70                  75                  80

Val Tyr Tyr Cys Ala Ala Xaa Xaa Xaa Xaa Xaa Trp Gly Gln Gly Thr
                85                  90                  95

Gln Val Thr Val Ser Ser
            100

```
<210>   5
<211>   102
<212>   PRT
<213>   Artificial Sequence

<220>
<223>   KERE-class Nanobody

<220>
<221>   misc_feature
<222>   (31)..(35)
```

FIGURE 10 Continued...

```
<223>  CDR

<220>
<221>  misc_feature
<222>  (50)..(54)
<223>  CDR

<220>
<221>  misc_feature
<222>  (87)..(91)
<223>  CDR

<400>  5
```

Ala Val Gln Leu Val Glu Ser Gly Gly Gly Leu Val Gln Gly Gly Gly
1               5                   10                  15

Ser Leu Arg Leu Ala Cys Ala Ala Ser Glu Arg Ile Phe Asp Xaa Xaa
            20                  25                  30

Xaa Xaa Xaa Trp Tyr Arg Gln Gly Pro Gly Asn Glu Arg Glu Leu Val
        35                  40                  45

Ala Xaa Xaa Xaa Xaa Xaa Arg Phe Thr Ile Ser Met Asp Tyr Thr Lys
    50                  55                  60

Gln Thr Val Tyr Leu His Met Asn Ser Leu Arg Pro Glu Asp Thr Gly
65                  70                  75                  80

Leu Tyr Tyr Cys Lys Ile Xaa Xaa Xaa Xaa Xaa Trp Gly Gln Gly Thr
            85                  90                  95

Gln Val Thr Val Ser Ser
            100

```
<210>  6
<211>  102
<212>  PRT
<213>  Artificial Sequence

<220>
<223>  KERE-class Nanobody

<220>
<221>  misc_feature
<222>  (31)..(35)
<223>  CDR

<220>
<221>  misc_feature
<222>  (50)..(54)
<223>  CDR
```

FIGURE 10 Continued...

```
<220>
<221>  misc_feature
<222>  (87)..(91)
<223>  CDR

<400>  6
```

| Asp | Val | Lys | Phe | Val | Glu | Ser | Gly | Gly | Gly | Leu | Val | Gln | Ala | Gly | Gly |
|-----|-----|-----|-----|-----|-----|-----|-----|-----|-----|-----|-----|-----|-----|-----|-----|
| 1   |     |     |     | 5   |     |     |     |     | 10  |     |     |     |     | 15  |     |

| Ser | Leu | Arg | Leu | Ser | Cys | Val | Ala | Ser | Gly | Phe | Asn | Phe | Asp | Xaa | Xaa |
|-----|-----|-----|-----|-----|-----|-----|-----|-----|-----|-----|-----|-----|-----|-----|-----|
|     |     |     | 20  |     |     |     |     | 25  |     |     |     |     | 30  |     |     |

| Xaa | Xaa | Xaa | Trp | Phe | Arg | Gln | Ala | Pro | Gly | Lys | Glu | Arg | Glu | Glu | Val |
|-----|-----|-----|-----|-----|-----|-----|-----|-----|-----|-----|-----|-----|-----|-----|-----|
|     |     | 35  |     |     |     |     | 40  |     |     |     |     | 45  |     |     |     |

| Ala | Xaa | Xaa | Xaa | Xaa | Xaa | Arg | Phe | Thr | Ile | Ser | Ser | Glu | Lys | Asp | Lys |
|-----|-----|-----|-----|-----|-----|-----|-----|-----|-----|-----|-----|-----|-----|-----|-----|
|     | 50  |     |     |     |     | 55  |     |     |     |     | 60  |     |     |     |     |

| Asn | Ser | Val | Tyr | Leu | Gln | Met | Asn | Ser | Leu | Lys | Pro | Glu | Asp | Thr | Ala |
|-----|-----|-----|-----|-----|-----|-----|-----|-----|-----|-----|-----|-----|-----|-----|-----|
| 65  |     |     |     | 70  |     |     |     |     | 75  |     |     |     |     | 80  |     |

| Leu | Tyr | Ile | Cys | Ala | Gly | Xaa | Xaa | Xaa | Xaa | Xaa | Trp | Gly | Arg | Gly | Thr |
|-----|-----|-----|-----|-----|-----|-----|-----|-----|-----|-----|-----|-----|-----|-----|-----|
|     |     |     |     | 85  |     |     |     |     | 90  |     |     |     |     | 95  |     |

| Gln | Val | Thr | Val | Ser | Ser |
|-----|-----|-----|-----|-----|-----|
|     |     |     | 100 |     |     |

```
<210>  7
<211>  102
<212>  PRT
<213>  Artificial Sequence

<220>
<223>  KERE-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

```
Gln Val Arg Leu Ala Glu Ser Gly Gly Gly Leu Val Gln Ser Gly Gly
1               5                   10                  15

Ser Leu Arg Leu Ser Cys Val Ala Ser Gly Ser Thr Tyr Thr Xaa Xaa
                20                  25                  30

Xaa Xaa Xaa Trp Tyr Arg Gln Tyr Pro Gly Lys Gln Arg Ala Leu Val
            35                  40                  45

Ala Xaa Xaa Xaa Xaa Xaa Arg Phe Thr Ile Ala Arg Asp Ser Thr Lys
    50                  55                  60

Asp Thr Phe Cys Leu Gln Met Asn Asn Leu Lys Pro Glu Asp Thr Ala
65                  70                  75                  80

Val Tyr Tyr Cys Tyr Ala Xaa Xaa Xaa Xaa Xaa Trp Gly Gln Gly Thr
                85                  90                  95

Gln Val Thr Val Ser Ser
            100

<210>  8
<211>  102
<212>  PRT
<213>  Artificial Sequence

<220>
<223>  KERE-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  8

Glu Val Gln Leu Val Glu Ser Gly Gly Gly Leu Val Gln Ala Gly Gly
1               5                   10                  15

Ser Leu Arg Leu Ser Cys Ala Ala Ser Gly Phe Thr Ser Asp Xaa Xaa
                20                  25                  30
```

FIGURE 10 Continued...

```
Xaa Xaa Xaa Trp Phe Arg Gln Ala Pro Gly Lys Pro Arg Glu Gly Val
        35                  40                  45

Ser Xaa Xaa Xaa Xaa Xaa Arg Phe Thr Ile Ser Thr Asp Asn Ala Lys
    50                  55                  60

Asn Thr Val His Leu Leu Met Asn Arg Val Asn Ala Glu Asp Thr Ala
65                  70                  75                  80

Leu Tyr Tyr Cys Ala Val Xaa Xaa Xaa Xaa Trp Gly Arg Gly Thr
                85                  90                  95

Arg Val Thr Val Ser Ser
                100

<210>  9
<211>  102
<212>  PRT
<213>  Artificial Sequence

<220>
<223>  KERE-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  9

Gln Val Gln Leu Val Glu Ser Gly Gly Gly Leu Val Gln Pro Gly Gly
1               5                   10                  15

Ser Leu Arg Leu Ser Cys Gln Ala Ser Gly Asp Ile Ser Thr Xaa Xaa
            20                  25                  30

Xaa Xaa Xaa Trp Tyr Arg Gln Val Pro Gly Lys Leu Arg Glu Phe Val
        35                  40                  45

Ala Xaa Xaa Xaa Xaa Xaa Arg Phe Thr Ile Ser Gly Asp Asn Ala Lys
    50                  55                  60
```

FIGURE 10 Continued...

```
Arg Ala Ile Tyr Leu Gln Met Asn Asn Leu Lys Pro Asp Asp Thr Ala
65                  70                  75                  80

Val Tyr Tyr Cys Asn Arg Xaa Xaa Xaa Xaa Xaa Trp Gly Gln Gly Thr
                85                  90                  95

Gln Val Thr Val Ser Pro
            100

<210> 10
<211> 102
<212> PRT
<213> Artificial Sequence

<220>
<223> KERE-class Nanobody

<220>
<221> misc_feature
<222> (31)..(35)
<223> CDR

<220>
<221> misc_feature
<222> (50)..(54)
<223> CDR

<220>
<221> misc_feature
<222> (87)..(91)
<223> CDR

<400> 10

Gln Val Pro Val Val Glu Ser Gly Gly Gly Leu Val Gln Ala Gly Asp
1               5                   10                  15

Ser Leu Arg Leu Phe Cys Ala Val Pro Ser Phe Thr Ser Thr Xaa Xaa
                20                  25                  30

Xaa Xaa Xaa Trp Phe Arg Gln Ala Pro Gly Lys Glu Arg Glu Phe Val
                35                  40                  45

Ala Xaa Xaa Xaa Xaa Xaa Arg Phe Thr Ile Ser Arg Asn Ala Thr Lys
    50                  55                  60

Asn Thr Leu Thr Leu Arg Met Asp Ser Leu Lys Pro Glu Asp Thr Ala
65                  70                  75                  80

Val Tyr Tyr Cys Ala Ala Xaa Xaa Xaa Xaa Xaa Trp Gly Gln Gly Thr
```

Gln Val Thr Val Ser Ser
                        100

<210>   11
        <211>   102
        <212>   PRT
        <213>   Artificial Sequence <220>
        <223>   KERE-class Nanobody <220>
        <221>   misc_feature
        <222>   (31)..(35)
        <223>   CDR <220>
        <221>   misc_feature
        <222>   (50)..(54)
        <223>   CDR <220>
        <221>   misc_feature
        <222>   (87)..(91)
        <223>   CDR

<400>   11

Glu Val Gln Leu Val Glu Ser Gly Gly Gly Leu Val Gln Ala Gly Asp
        1               5                   10                  15

Ser Leu Arg Leu Phe Cys Thr Val Ser Gly Gly Thr Ala Ser Xaa Xaa
                        20                  25                  30

Xaa Xaa Xaa Trp Phe Arg Gln Ala Pro Gly Glu Lys Arg Glu Phe Val
                        35                  40                  45

Ala Xaa Xaa Xaa Xaa Xaa Arg Phe Thr Ile Ala Arg Glu Asn Ala Gly
            50                  55                  60

Asn Met Val Tyr Leu Gln Met Asn Asn Leu Lys Pro Asp Asp Thr Ala
        65                  70                  75                  80

Leu Tyr Thr Cys Ala Ala Xaa Xaa Xaa Xaa Xaa Trp Gly Arg Gly Thr
                        85                  90                  95

Gln Val Thr Val Ser Ser
                        100
```

FIGURE 10 Continued...

```
<210>  12
<211>  102
<212>  PRT
<213>  Artificial Sequence

<220>
<223>  KERE-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  12
```

Ala Val Gln Leu Val Glu Ser Gly Gly Asp Ser Val Gln Pro Gly Asp
1               5                   10                  15

Ser Gln Thr Leu Ser Cys Ala Ala Ser Gly Arg Thr Asn Ser Xaa Xaa
                20                  25                  30

Xaa Xaa Xaa Trp Phe Arg Gln Ala Pro Gly Lys Glu Arg Val Phe Leu
            35                  40                  45

Ala Xaa Xaa Xaa Xaa Xaa Arg Phe Thr Ile Ser Arg Asp Ser Ala Lys
    50                  55                  60

Asn Met Met Tyr Leu Gln Met Asn Asn Leu Lys Pro Gln Asp Thr Ala
65                  70                  75                  80

Val Tyr Tyr Cys Ala Ala Xaa Xaa Xaa Xaa Xaa Trp Gly Gln Gly Thr
                85                  90                  95

Gln Val Thr Val Ser Ser
            100

```
<210>  13
<211>  102
<212>  PRT
<213>  Artificial Sequence

<220>
<223>  KERE-class Nanobody
```

FIGURE 10 Continued...

```
<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  13
```

Ala Val Gln Leu Val Glu Ser Gly Gly Gly Leu Val Gln Ala Gly Gly
1               5                   10                  15

Ser Leu Arg Leu Ser Cys Val Val Ser Gly Leu Thr Ser Ser Xaa Xaa
            20                  25                  30

Xaa Xaa Xaa Trp Phe Arg Gln Thr Pro Trp Gln Glu Arg Asp Phe Val
        35                  40                  45

Ala Xaa Xaa Xaa Xaa Xaa Arg Phe Thr Ile Ser Arg Asp Asn Tyr Lys
    50                  55                  60

Asp Thr Val Leu Leu Glu Met Asn Phe Leu Lys Pro Glu Asp Thr Ala
65                  70                  75                  80

Ile Tyr Tyr Cys Ala Ala Xaa Xaa Xaa Xaa Xaa Trp Gly Gln Gly Thr
                85                  90                  95

Gln Val Thr Val Ser Ser
            100

```
<210>  14
<211>  102
<212>  PRT
<213>  Artificial Sequence

<220>
<223>  KERE-class Nanobody

<220>
<221>  misc_feature
<222>  (31)..(35)
<223>  CDR
```

FIGURE 10 Continued...

```
<220>
<221>  misc_feature
<222>  (50)..(54)
<223>  CDR

<220>
<221>  misc_feature
<222>  (87)..(91)
<223>  CDR

<400>  14
```

| | | | | | | | | | | | | | | | |
|---|---|---|---|---|---|---|---|---|---|---|---|---|---|---|---|
| Ala | Val | Gln | Leu | Val | Glu | Ser | Gly | Gly | Gly | Leu | Val | Gln | Ala | Gly | Ala |
| 1 | | | | 5 | | | | | 10 | | | | | 15 | |
| Ser | Leu | Arg | Leu | Ser | Cys | Ala | Thr | Ser | Thr | Arg | Thr | Leu | Asp | Xaa | Xaa |
| | | | 20 | | | | | 25 | | | | | 30 | | |
| Xaa | Xaa | Xaa | Trp | Phe | Arg | Gln | Ala | Pro | Gly | Arg | Asp | Arg | Glu | Phe | Val |
| | | 35 | | | | | 40 | | | | | 45 | | | |
| Ala | Xaa | Xaa | Xaa | Xaa | Xaa | Arg | Phe | Thr | Val | Ser | Arg | Asp | Ser | Ala | Glu |
| | 50 | | | | | 55 | | | | | 60 | | | | |
| Asn | Thr | Val | Ala | Leu | Gln | Met | Asn | Ser | Leu | Lys | Pro | Glu | Asp | Thr | Ala |
| 65 | | | | 70 | | | | | 75 | | | | | 80 | |
| Val | Tyr | Tyr | Cys | Ala | Ala | Xaa | Xaa | Xaa | Xaa | Xaa | Trp | Gly | Gln | Gly | Thr |
| | | | 85 | | | | | 90 | | | | | 95 | | |
| Arg | Val | Thr | Val | Ser | Ser | | | | | | | | | | |
| | | | 100 | | | | | | | | | | | | |

```
<210>  15
<211>  102
<212>  PRT
<213>  Artificial Sequence

<220>
<223>  KERE-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
```

FIGURE 10 Continued...

```
<222>   (87)..(91)
<223>   CDR

<400>   15
```

| | | | | | | | | | | | | | | |
|---|---|---|---|---|---|---|---|---|---|---|---|---|---|---|
| Gln | Val | Gln | Leu | Val | Glu | Ser | Gly | Gly | Gly | Leu | Val | Gln | Pro | Gly | Gly |
| 1 | | | | 5 | | | | | 10 | | | | | 15 | |

| Ser | Leu | Arg | Leu | Ser | Cys | Thr | Val | Ser | Arg | Leu | Thr | Ala | His | Xaa | Xaa |
|---|---|---|---|---|---|---|---|---|---|---|---|---|---|---|---|
| | | | 20 | | | | | 25 | | | | | 30 | | |

| Xaa | Xaa | Xaa | Trp | Phe | Arg | Gln | Ala | Pro | Gly | Lys | Glu | Arg | Glu | Ala | Val |
|---|---|---|---|---|---|---|---|---|---|---|---|---|---|---|---|
| | | 35 | | | | | 40 | | | | | 45 | | | |

| Ser | Xaa | Xaa | Xaa | Xaa | Xaa | Arg | Phe | Thr | Ile | Ser | Arg | Asp | Tyr | Ala | Gly |
|---|---|---|---|---|---|---|---|---|---|---|---|---|---|---|---|
| | 50 | | | | | 55 | | | | | 60 | | | | |

| Asn | Thr | Ala | Phe | Leu | Gln | Met | Asp | Ser | Leu | Lys | Pro | Glu | Asp | Thr | Gly |
|---|---|---|---|---|---|---|---|---|---|---|---|---|---|---|---|
| 65 | | | | | 70 | | | | | 75 | | | | | 80 |

| Val | Tyr | Tyr | Cys | Ala | Thr | Xaa | Xaa | Xaa | Xaa | Xaa | Trp | Gly | Gln | Gly | Thr |
|---|---|---|---|---|---|---|---|---|---|---|---|---|---|---|---|
| | | | | 85 | | | | | 90 | | | | | 95 | |

| Gln | Val | Thr | Val | Ser | Ser |
|---|---|---|---|---|---|
| | | | | 100 | |

```
<210>   16
<211>   102
<212>   PRT
<213>   Artificial Sequence

<220>
<223>   KERE-class Nanobody

<220>
<221>   misc_feature
<222>   (31)..(35)
<223>   CDR

<220>
<221>   misc_feature
<222>   (50)..(54)
<223>   CDR

<220>
<221>   misc_feature
<222>   (87)..(91)
<223>   CDR

<400>   16
```

| Glu | Val | Gln | Leu | Val | Glu | Ser | Gly | Gly | Glu | Leu | Val | Gln | Ala | Gly | Gly |
|---|---|---|---|---|---|---|---|---|---|---|---|---|---|---|---|
| 1 | | | | 5 | | | | | 10 | | | | | 15 | |

FIGURE 10 Continued...

```
Ser Leu Lys Leu Ser Cys Thr Ala Ser Gly Arg Asn Phe Val Xaa Xaa
            20                  25                  30

Xaa Xaa Xaa Trp Phe Arg Arg Ala Pro Gly Lys Glu Arg Glu Phe Val
            35                  40                  45

Ala Xaa Xaa Xaa Xaa Xaa Arg Phe Thr Val Ser Arg Asp Asn Gly Lys
            50                  55                  60

Asn Thr Ala Tyr Leu Arg Met Asn Ser Leu Lys Pro Glu Asp Thr Ala
65                  70                  75                  80

Asp Tyr Tyr Cys Ala Val Xaa Xaa Xaa Xaa Xaa Leu Gly Ser Gly Thr
                85                  90                  95

Gln Val Thr Val Ser Ser
            100

<210> 17
<211> 102
<212> PRT
<213> Artificial Sequence

<220>
<223> GLEW-class Nanobody

<220>
<221> misc_feature
<222> (31)..(35)
<223> CDR

<220>
<221> misc_feature
<222> (50)..(54)
<223> CDR

<220>
<221> misc_feature
<222> (87)..(91)
<223> CDR

<400> 17

Ala Val Gln Leu Val Glu Ser Gly Gly Gly Leu Val Gln Pro Gly Gly
1               5                   10                  15

Ser Leu Arg Leu Ser Cys Ala Ala Ser Gly Phe Thr Phe Ser Xaa Xaa
            20                  25                  30

Xaa Xaa Xaa Trp Val Arg Gln Ala Pro Gly Lys Val Leu Glu Trp Val
```

Ser Xaa Xaa Xaa Xaa Xaa Arg Phe Thr Ile Ser Arg Asp Asn Ala Lys
        50                  55                  60

Asn Thr Leu Tyr Leu Gln Met Asn Ser Leu Lys Pro Glu Asp Thr Ala
    65                  70                  75                  80

Val Tyr Tyr Cys Val Lys Xaa Xaa Xaa Xaa Xaa Gly Ser Gln Gly Thr
                        85                  90                  95

Gln Val Thr Val Ser Ser
                    100

<210> 18
<211> 102
<212> PRT
<213> Artificial Sequence

<220>
<223> GLEW-class Nanobody

<220>
<221> misc_feature
<222> (31)..(35)
<223> CDR

<220>
<221> misc_feature
<222> (50)..(54)
<223> CDR

<220>
<221> misc_feature
<222> (87)..(91)
<223> CDR

<400> 18

Glu Val Gln Leu Val Glu Ser Gly Gly Gly Leu Val Gln Pro Gly Gly
    1               5                   10                  15

Ser Leu Arg Leu Ser Cys Val Cys Val Ser Ser Gly Cys Thr Xaa Xaa
                    20                  25                  30

Xaa Xaa Xaa Trp Val Arg Gln Ala Pro Gly Lys Ala Glu Glu Trp Val
                    35                  40                  45

Ser Xaa Xaa Xaa Xaa Xaa Arg Phe Lys Ile Ser Arg Asp Asn Ala Lys
        50                  55                  60
```

FIGURE 10 Continued...

```
Lys Thr Leu Tyr Leu Gln Met Asn Ser Leu Gly Pro Glu Asp Thr Ala
65                  70                  75                  80

Met Tyr Tyr Cys Gln Arg Xaa Xaa Xaa Xaa Xaa Arg Gly Gln Gly Thr
                85                  90                  95

Gln Val Thr Val Ser Ser
            100

<210> 19
<211> 102
<212> PRT
<213> Artificial Sequence

<220>
<223> GLEW-class Nanobody

<220>
<221> misc_feature
<222> (31)..(35)
<223> CDR

<220>
<221> misc_feature
<222> (50)..(54)
<223> CDR

<220>
<221> misc_feature
<222> (87)..(91)
<223> CDR

<400> 19

Glu Val Gln Leu Val Glu Ser Gly Gly Gly Leu Ala Leu Pro Gly Gly
1               5                   10                  15

Ser Leu Thr Leu Ser Cys Val Phe Ser Gly Ser Thr Phe Ser Xaa Xaa
                20                  25                  30

Xaa Xaa Xaa Trp Val Arg His Thr Pro Gly Lys Ala Glu Glu Trp Val
            35                  40                  45

Ser Xaa Xaa Xaa Xaa Xaa Arg Phe Thr Ile Ser Arg Asp Asn Ala Lys
    50                  55                  60

Asn Thr Leu Tyr Leu Glu Met Asn Ser Leu Ser Pro Glu Asp Thr Ala
65                  70                  75                  80

Met Tyr Tyr Cys Gly Arg Xaa Xaa Xaa Xaa Xaa Arg Ser Lys Gly Ile
                85                  90                  95
```

FIGURE 10 Continued...

```
Gln Val Thr Val Ser Ser
            100

<210>  20
<211>  102
<212>  PRT
<213>  Artificial Sequence

<220>
<223>  P,R,S 103-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  20

Ala Val Gln Leu Val Glu Ser Gly Gly Gly Leu Val Gln Ala Gly Gly
1               5                   10                  15

Ser Leu Arg Leu Ser Cys Ala Ala Ser Gly Arg Thr Phe Ser Xaa Xaa
            20                  25                  30

Xaa Xaa Xaa Trp Phe Arg Gln Ala Pro Gly Lys Glu Arg Glu Phe Val
            35                  40                  45

Ala Xaa Xaa Xaa Xaa Xaa Arg Phe Thr Ile Ser Arg Asp Asn Ala Lys
    50                  55                  60

Asn Thr Val Tyr Leu Gln Met Asn Ser Leu Lys Pro Glu Asp Thr Ala
65                  70                  75                  80

Val Tyr Tyr Cys Ala Ala Xaa Xaa Xaa Xaa Xaa Arg Gly Gln Gly Thr
                85                  90                  95

Gln Val Thr Val Ser Ser
            100

```
<212>  PRT
<213>  Artificial Sequence

<220>
<223>  P,R,S 103-class Nanobody

<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  21
```

Asp Val Gln Leu Val Glu Ser Gly Gly Asp Leu Val Gln Pro Gly Gly
1               5                   10                  15

Ser Leu Arg Leu Ser Cys Ala Ala Ser Gly Phe Ser Phe Asp Xaa Xaa
            20                  25                  30

Xaa Xaa Xaa Trp Leu Arg Gln Thr Pro Gly Lys Gly Leu Glu Trp Val
            35                  40                  45

Gly Xaa Xaa Xaa Xaa Xaa Arg Phe Thr Ile Ser Arg Asp Asn Ala Lys
        50                  55                  60

Asn Met Leu Tyr Leu His Leu Asn Asn Leu Lys Ser Glu Asp Thr Ala
65                  70                  75                  80

Val Tyr Tyr Cys Arg Arg Xaa Xaa Xaa Xaa Xaa Leu Gly Gln Gly Thr
                85                  90                  95

Gln Val Thr Val Ser Ser
            100

```
<210>  22
<211>  102
<212>  PRT
<213>  Artificial Sequence

<220>
<223>  P,R,S 103-class Nanobody
```

FIGURE 10 Continued...

```
<220>
<221>  misc_feature
<222>  (31)..(35)
<223>  CDR

<220>
<221>  misc_feature
<222>  (50)..(54)
<223>  CDR

<220>
<221>  misc_feature
<222>  (87)..(91)
<223>  CDR

<400>  22
```

Glu Val Gln Leu Val Glu Ser Gly Gly Gly Leu Val Gln Pro Gly Gly
1               5                   10                  15

Ser Leu Arg Leu Ser Cys Val Cys Val Ser Ser Gly Cys Thr Xaa Xaa
            20                  25                  30

Xaa Xaa Xaa Trp Val Arg Gln Ala Pro Gly Lys Ala Glu Glu Trp Val
        35                  40                  45

Ser Xaa Xaa Xaa Xaa Xaa Arg Phe Lys Ile Ser Arg Asp Asn Ala Lys
    50                  55                  60

Lys Thr Leu Tyr Leu Gln Met Asn Ser Leu Gly Pro Glu Asp Thr Ala
65                  70                  75                  80

Met Tyr Tyr Cys Gln Arg Xaa Xaa Xaa Xaa Xaa Arg Gly Gln Gly Thr
            85                  90                  95

Gln Val Thr Val Ser Ser
            100

```
<210>  23
<211>  30
<212>  PRT
<213>  Artificial Sequence

<220>
<223>  KERE-class Nanobody FW1 sequence

<400>  23
```

Gln Val Gln Arg Val Glu Ser Gly Gly Gly Leu Val Gln Ala Gly Gly
1               5                   10                  15

Ser Leu Arg Leu Ser Cys Ala Ala Ser Gly Arg Thr Ser Ser
            20                  25                  30

FIGURE 10 Continued...

```
<210> 24
<211> 30
<212> PRT
<213> Artificial Sequence

<220>
<223> KERE-class Nanobody FW1 sequence

<400> 24

Gln Val Gln Leu Val Glu Ser Gly Gly Gly Leu Val Gln Thr Gly Asp
1               5                   10                  15

Ser Leu Ser Leu Ser Cys Ser Ala Ser Gly Arg Thr Phe Ser
            20                  25                  30

<210> 25
<211> 30
<212> PRT
<213> Artificial Sequence

<220>
<223> KERE-class Nanobody FW1 sequence

<400> 25

Gln Val Lys Leu Glu Glu Ser Gly Gly Gly Leu Val Gln Ala Gly Asp
1               5                   10                  15

Ser Leu Arg Leu Ser Cys Ala Ala Thr Gly Arg Ala Phe Gly
            20                  25                  30

<210> 26
<211> 30
<212> PRT
<213> Artificial Sequence

<220>
<223> KERE-class Nanobody FW1 sequence

<400> 26

Ala Val Gln Leu Val Glu Ser Gly Gly Gly Leu Val Gln Pro Gly Glu
1               5                   10                  15

Ser Leu Gly Leu Ser Cys Val Ala Ser Gly Arg Asp Phe Val
            20                  25                  30

<210> 27
<211> 30
<212> PRT
<213> Artificial Sequence
```

FIGURE 10 Continued...

```
<220>
<223>  KERE-class Nanobody FW1 sequence

<400>  27

Glu Val Gln Leu Val Glu Ser Gly Gly Gly Leu Val Gln Ala Gly Gly
1               5                   10                  15

Ser Leu Arg Leu Ser Cys Glu Val Leu Gly Arg Thr Ala Gly
            20                  25                  30

<210>  28
<211>  30
<212>  PRT
<213>  Artificial Sequence

<220>
<223>  KERE-class Nanobody FW1 sequence

<400>  28

Gln Val Gln Leu Val Glu Ser Gly Gly Gly Trp Val Gln Pro Gly Gly
1               5                   10                  15

Ser Leu Arg Leu Ser Cys Ala Ala Ser Glu Thr Ile Leu Ser
            20                  25                  30

<210>  29
<211>  30
<212>  PRT
<213>  Artificial Sequence

<220>
<223>  KERE-class Nanobody FW1 sequence

<400>  29

Gln Val Gln Leu Val Glu Ser Gly Gly Gly Thr Val Gln Pro Gly Gly
1               5                   10                  15

Ser Leu Asn Leu Ser Cys Val Ala Ser Gly Asn Thr Phe Asn
            20                  25                  30

<210>  30
<211>  30
<212>  PRT
<213>  Artificial Sequence

<220>
<223>  KERE-class Nanobody FW1 sequence

<400>  30

Glu Val Gln Leu Val Glu Ser Gly Gly Gly Leu Ala Gln Pro Gly Gly
1               5                   10                  15
```

FIGURE 10 Continued...

```
Ser Leu Gln Leu Ser Cys Ser Ala Pro Gly Phe Thr Leu Asp
            20                  25                  30

<210> 31
<211> 30
<212> PRT
<213> Artificial Sequence

<220>
<223> KERE-class Nanobody FW1 sequence

<400> 31

Ala Gln Glu Leu Glu Glu Ser Gly Gly Gly Leu Val Gln Ala Gly Gly
1               5                   10                  15

Ser Leu Arg Leu Ser Cys Ala Ala Ser Gly Arg Thr Phe Asn
            20                  25                  30

<210> 32
<211> 22
<212> PRT
<213> Artificial Sequence

<220>
<223> KERE-class Nanobody FW1 sequence

<400> 32

Val Glu Ser Gly Gly Gly Leu Val Gln Pro Gly Gly Ser Leu Arg Leu
1               5                   10                  15

Ser Cys Ala Ala Ser Gly
            20

<210> 33
<211> 22
<212> PRT
<213> Artificial Sequence

<220>
<223> KERE-class Nanobody FW1 sequence

<400> 33

Val Asp Ser Gly Gly Gly Leu Val Gln Ala Gly Asp Ser Leu Lys Leu
1               5                   10                  15

Ser Cys Ala Leu Thr Gly
            20

```
<211> 22
<212> PRT
<213> Artificial Sequence

<220>
<223> KERE-class Nanobody FW1 sequence

<400> 34

Val Asp Ser Gly Gly Gly Leu Val Gln Ala Gly Asp Ser Leu Arg Leu
1               5                   10                  15

Ser Cys Ala Ala Ser Gly
            20

<210> 35
<211> 22
<212> PRT
<213> Artificial Sequence

<220>
<223> KERE-class Nanobody FW1 sequence

<400> 35

Val Asp Ser Gly Gly Gly Leu Val Glu Ala Gly Gly Ser Leu Arg Leu
1               5                   10                  15

Ser Cys Gln Val Ser Glu
            20

<210> 36
<211> 22
<212> PRT
<213> Artificial Sequence

<220>
<223> KERE-class Nanobody FW1 sequence

<400> 36

Gln Asp Ser Gly Gly Gly Ser Val Gln Ala Gly Gly Ser Leu Lys Leu
1               5                   10                  15

Ser Cys Ala Ala Ser Gly
            20

<210> 37
<211> 22
<212> PRT
<213> Artificial Sequence

<220>
<223> KERE-class Nanobody FW1 sequence
```

Val Gln Ser Gly Gly Arg Leu Val Gln Ala Gly Asp Ser Leu Arg Leu
1               5                   10                  15

Ser Cys Ala Ala Ser Glu
            20

<210> 38
<211> 22
<212> PRT
<213> Artificial Sequence

<220>
<223> KERE-class Nanobody FW1 sequence

<400> 38

Val Glu Ser Gly Gly Thr Leu Val Gln Ser Gly Asp Ser Leu Lys Leu
1               5                   10                  15

Ser Cys Ala Ser Ser Thr
            20

<210> 39
<211> 22
<212> PRT
<213> Artificial Sequence

<220>
<223> KERE-class Nanobody FW1 sequence

<400> 39

Met Glu Ser Gly Gly Asp Ser Val Gln Ser Gly Gly Ser Leu Thr Leu
1               5                   10                  15

Ser Cys Val Ala Ser Gly
            20

<210> 40
<211> 22
<212> PRT
<213> Artificial Sequence

<220>
<223> KERE-class Nanobody FW1 sequence

<400> 40

Gln Ala Ser Gly Gly Gly Leu Val Gln Ala Gly Gly Ser Leu Arg Leu
1               5                   10                  15

Ser Cys Ser Ala Ser Val
```

```
<210>  41
<211>  14
<212>  PRT
<213>  Artificial Sequence

<220>
<223>  KERE-class Nanobody FW2 sequence

<400>  41

Trp Phe Arg Gln Ala Pro Gly Lys Glu Arg Glu Phe Val Ala
1               5                   10

<210>  42
<211>  14
<212>  PRT
<213>  Artificial Sequence

<220>
<223>  KERE-class Nanobody FW2 sequence

<400>  42

Trp Phe Arg Gln Thr Pro Gly Arg Glu Arg Glu Phe Val Ala
1               5                   10

<210>  43
<211>  14
<212>  PRT
<213>  Artificial Sequence

<220>
<223>  KERE-class Nanobody FW2 sequence

<400>  43

Trp Tyr Arg Gln Ala Pro Gly Lys Gln Arg Glu Met Val Ala
1               5                   10

<210>  44
<211>  14
<212>  PRT
<213>  Artificial Sequence

<220>
<223>  KERE-class Nanobody FW2 sequence

<400>  44

Trp Tyr Arg Gln Gly Pro Gly Lys Gln Arg Glu Leu Val Ala
1               5                   10

```
<212> PRT
<213> Artificial Sequence

<220>
<223> KERE-class Nanobody FW2 sequence

<400> 45

Trp Ile Arg Gln Ala Pro Gly Lys Glu Arg Glu Gly Val Ser
1               5                   10

<210> 46
<211> 14
<212> PRT
<213> Artificial Sequence

<220>
<223> KERE-class Nanobody FW2 sequence

<400> 46

Trp Phe Arg Glu Ala Pro Gly Lys Glu Arg Glu Gly Ile Ser
1               5                   10

<210> 47
<211> 14
<212> PRT
<213> Artificial Sequence

<220>
<223> KERE-class Nanobody FW2 sequence

<400> 47

Trp Tyr Arg Gln Ala Pro Gly Lys Glu Arg Asp Leu Val Ala
1               5                   10

<210> 48
<211> 14
<212> PRT
<213> Artificial Sequence

<220>
<223> KERE-class Nanobody FW2 sequence

<400> 48

Trp Phe Arg Gln Ala Pro Gly Lys Gln Arg Glu Glu Val Ser
1               5                   10

<210> 49
<211> 14
<212> PRT
<213> Artificial Sequence

<220>
<223> KERE-class Nanobody FW2 sequence
```

Trp Phe Arg Gln Pro Pro Gly Lys Val Arg Glu Phe Val Gly
1               5                   10

<210>  50
<211>  32
<212>  PRT
<213>  Artificial Sequence

<220>
<223>  KERE-class Nanobody FW3 sequence

<400>  50

Arg Phe Thr Ile Ser Arg Asp Asn Ala Lys Asn Thr Val Tyr Leu Gln
1               5                   10                  15

Met Asn Ser Leu Lys Pro Glu Asp Thr Ala Val Tyr Arg Cys Tyr Phe
                20                  25                  30

<210>  51
<211>  32
<212>  PRT
<213>  Artificial Sequence

<220>
<223>  KERE-class Nanobody FW3 sequence

<400>  51

Arg Phe Ala Ile Ser Arg Asp Asn Asn Lys Asn Thr Gly Tyr Leu Gln
1               5                   10                  15

Met Asn Ser Leu Glu Pro Glu Asp Thr Ala Val Tyr Tyr Cys Ala Ala
                20                  25                  30

<210>  52
<211>  32
<212>  PRT
<213>  Artificial Sequence

<220>
<223>  KERE-class Nanobody FW3 sequence

<400>  52

Arg Phe Thr Val Ala Arg Asn Asn Ala Lys Asn Thr Val Asn Leu Glu
1               5                   10                  15

Met Asn Ser Leu Lys Pro Glu Asp Thr Ala Val Tyr Tyr Cys Ala Ala
                20                  25                  30
```

FIGURE 10 Continued...

```
<210>  53
<211>  32
<212>  PRT
<213>  Artificial Sequence

<220>
<223>  KERE-class Nanobody FW3 sequence

<400>  53

Arg Phe Thr Ile Ser Arg Asp Ile Ala Lys Asn Thr Val Asp Leu Leu
1               5                   10                  15

Met Asn Asn Leu Glu Pro Glu Asp Thr Ala Val Tyr Tyr Cys Ala Ala
            20                  25                  30

<210>  54
<211>  32
<212>  PRT
<213>  Artificial Sequence

<220>
<223>  KERE-class Nanobody FW3 sequence

<400>  54

Arg Leu Thr Ile Ser Arg Asp Asn Ala Val Asp Thr Met Tyr Leu Gln
1               5                   10                  15

Met Asn Ser Leu Lys Pro Glu Asp Thr Ala Val Tyr Tyr Cys Ala Ala
            20                  25                  30

<210>  55
<211>  32
<212>  PRT
<213>  Artificial Sequence

<220>
<223>  KERE-class Nanobody FW3 sequence

<400>  55

Arg Phe Thr Ile Ser Arg Asp Asn Ala Lys Asn Thr Val Tyr Leu Gln
1               5                   10                  15

Met Asp Asn Val Lys Pro Glu Asp Thr Ala Ile Tyr Tyr Cys Ala Ala
            20                  25                  30

<210>  56
<211>  32
<212>  PRT
<213>  Artificial Sequence

<220>
<223>  KERE-class Nanobody FW3 sequence
```

Arg Phe Thr Ile Ser Lys Asp Ser Gly Lys Asn Thr Val Tyr Leu Gln
1               5                   10                  15

Met Thr Ser Leu Lys Pro Glu Asp Thr Ala Val Tyr Tyr Cys Ala Thr
                20                  25                  30

<210> 57
<211> 32
<212> PRT
<213> Artificial Sequence

<220>
<223> KERE-class Nanobody FW3 sequence

<400> 57

Arg Phe Thr Ile Ser Arg Asp Ser Ala Lys Asn Met Met Tyr Leu Gln
1               5                   10                  15

Met Asn Asn Leu Lys Pro Gln Asp Thr Ala Val Tyr Tyr Cys Ala Ala
                20                  25                  30

<210> 58
<211> 32
<212> PRT
<213> Artificial Sequence

<220>
<223> KERE-class Nanobody FW3 sequence

<400> 58

Arg Phe Thr Ile Ser Arg Glu Asn Asp Lys Ser Thr Val Tyr Leu Gln
1               5                   10                  15

Leu Asn Ser Leu Lys Pro Glu Asp Thr Ala Val Tyr Tyr Cys Ala Ala
                20                  25                  30

<210> 59
<211> 32
<212> PRT
<213> Artificial Sequence

<220>
<223> KERE-class Nanobody FW3 sequence

<400> 59

Arg Phe Thr Ile Ser Arg Asp Tyr Ala Gly Asn Thr Ala Tyr Leu Gln
1               5                   10                  15
```

FIGURE 10 Continued...

```
Met Asn Ser Leu Lys Pro Glu Asp Thr Gly Val Tyr Tyr Cys Ala Thr
              20                  25                  30

<210>  60
<211>  11
<212>  PRT
<213>  Artificial Sequence

<220>
<223>  KERE-class Nanobody FW4 sequence

<400>  60

Trp Gly Gln Gly Thr Gln Val Thr Val Ser Ser
1               5                   10

<210>  61
<211>  11
<212>  PRT
<213>  Artificial Sequence

<220>
<223>  KERE-class Nanobody FW4 sequence

<400>  61

Trp Gly Lys Gly Thr Leu Val Thr Val Ser Ser
1               5                   10

<210>  62
<211>  11
<212>  PRT
<213>  Artificial Sequence

<220>
<223>  KERE-class Nanobody FW4 sequence

<400>  62

Arg Gly Gln Gly Thr Arg Val Thr Val Ser Ser
1               5                   10

<210>  63
<211>  11
<212>  PRT
<213>  Artificial Sequence

<220>
<223>  KERE-class Nanobody FW4 sequence

<400>  63

Trp Gly Leu Gly Thr Gln Val Thr Ile Ser Ser
1               5                   10

```
<211> 30
<212> PRT
<213> Artificial Sequence

<220>
<223> GLEW-class Nanobody FW1 sequence

<400> 64

Gln Val Gln Leu Val Glu Ser Gly Gly Gly Leu Val Gln Pro Gly Gly
1               5                   10                  15

Ser Leu Arg Leu Ser Cys Ala Ala Ser Gly Phe Thr Phe Ser
            20                  25                  30

<210> 65
<211> 30
<212> PRT
<213> Artificial Sequence

<220>
<223> GLEW-class Nanobody FW1 sequence

<400> 65

Glu Val His Leu Val Glu Ser Gly Gly Gly Leu Val Arg Pro Gly Gly
1               5                   10                  15

Ser Leu Arg Leu Ser Cys Ala Ala Phe Gly Phe Ile Phe Lys
            20                  25                  30

<210> 66
<211> 30
<212> PRT
<213> Artificial Sequence

<220>
<223> GLEW-class Nanobody FW1 sequence

<400> 66

Gln Val Lys Leu Glu Glu Ser Gly Gly Gly Leu Ala Gln Pro Gly Gly
1               5                   10                  15

Ser Leu Arg Leu Ser Cys Val Ala Ser Gly Phe Thr Phe Ser
            20                  25                  30

<210> 67
<211> 30
<212> PRT
<213> Artificial Sequence

<220>
<223> GLEW-class Nanobody FW1 sequence
```

Glu Val Gln Leu Val Glu Ser Gly Gly Gly Leu Val Gln Pro Gly Gly
1               5                   10                  15

Ser Leu Arg Leu Ser Cys Val Cys Val Ser Ser Gly Cys Thr
                20                  25                  30

<210>  68
<211>  30
<212>  PRT
<213>  Artificial Sequence

<220>
<223>  GLEW-class Nanobody FW1 sequence

<400>  68

Glu Val Gln Leu Val Glu Ser Gly Gly Gly Leu Ala Leu Pro Gly Gly
1               5                   10                  15

Ser Leu Thr Leu Ser Cys Val Phe Ser Gly Ser Thr Phe Ser
                20                  25                  30

<210>  69
<211>  22
<212>  PRT
<213>  Artificial Sequence

<220>
<223>  GLEW-class Nanobody FW1 sequence

<400>  69

Val Glu Ser Gly Gly Gly Leu Val Gln Pro Gly Gly Ser Leu Arg Leu
1               5                   10                  15

Ser Cys Ala Ala Ser Gly
                20

<210>  70
<211>  22
<212>  PRT
<213>  Artificial Sequence

<220>
<223>  GLEW-class Nanobody FW1 sequence

<400>  70

Glu Glu Ser Gly Gly Gly Leu Ala Gln Pro Gly Gly Ser Leu Arg Leu
1               5                   10                  15

Ser Cys Val Ala Ser Gly
```

```
<210>  71
<211>  22
<212>  PRT
<213>  Artificial Sequence

<220>
<223>  GLEW-class Nanobody FW1 sequence

<400>  71
```

Val Glu Ser Gly Gly Gly Leu Ala Leu Pro Gly Gly Ser Leu Thr Leu
1               5                   10                  15

Ser Cys Val Phe Ser Gly
            20

```
<210>  72
<211>  14
<212>  PRT
<213>  Artificial Sequence

<220>
<223>  GLEW-class Nanobody FW2 sequence

<400>  72
```

Trp Val Arg Gln Ala Pro Gly Lys Val Leu Glu Trp Val Ser
1               5                   10

```
<210>  73
<211>  14
<212>  PRT
<213>  Artificial Sequence

<220>
<223>  GLEW-class Nanobody FW2 sequence

<400>  73
```

Trp Val Arg Arg Pro Pro Gly Lys Gly Leu Glu Trp Val Ser
1               5                   10

```
<210>  74
<211>  14
<212>  PRT
<213>  Artificial Sequence

<220>
<223>  GLEW-class Nanobody FW2 sequence

<400>  74
```

Trp Val Arg Gln Ala Pro Gly Met Gly Leu Glu Trp Val Ser
1               5                   10

FIGURE 10 Continued...

```
<210>  75
<211>  14
<212>  PRT
<213>  Artificial Sequence

<220>
<223>  GLEW-class Nanobody FW2 sequence

<400>  75

Trp Val Arg Gln Ala Pro Gly Lys Glu Pro Glu Trp Val Ser
1               5                   10

<210>  76
<211>  14
<212>  PRT
<213>  Artificial Sequence

<220>
<223>  GLEW-class Nanobody FW2 sequence

<400>  76

Trp Val Arg Gln Ala Pro Gly Lys Asp Gln Glu Trp Val Ser
1               5                   10

<210>  77
<211>  14
<212>  PRT
<213>  Artificial Sequence

<220>
<223>  GLEW-class Nanobody FW2 sequence

<400>  77

Trp Val Arg Gln Ala Pro Gly Lys Ala Glu Glu Trp Val Ser
1               5                   10

<210>  78
<211>  14
<212>  PRT
<213>  Artificial Sequence

<220>
<223>  GLEW-class Nanobody FW2 sequence

<400>  78

Trp Val Arg Gln Ala Pro Gly Lys Gly Leu Glu Trp Val Ala
1               5                   10

<210>  79
<211>  14
<212>  PRT
```

FIGURE 10 Continued...

```
<213>  Artificial Sequence

<220>
<223>  GLEW-class Nanobody FW2 sequence

<400>  79

Trp Val Arg Gln Ala Pro Gly Arg Ala Thr Glu Trp Val Ser
1               5                   10

<210>  80
<211>  32
<212>  PRT
<213>  Artificial Sequence

<220>
<223>  GLEW-class Nanobody FW3 sequence

<400>  80

Arg Phe Thr Ile Ser Arg Asp Asn Ala Lys Asn Thr Leu Tyr Leu Gln
1               5                   10                  15

Met Asn Ser Leu Lys Pro Glu Asp Thr Ala Val Tyr Tyr Cys Val Lys
                20                  25                  30

<210>  81
<211>  32
<212>  PRT
<213>  Artificial Sequence

<220>
<223>  GLEW-class Nanobody FW3 sequence

<400>  81

Arg Phe Thr Ile Ser Arg Asp Asn Ala Arg Asn Thr Leu Tyr Leu Gln
1               5                   10                  15

Met Asp Ser Leu Ile Pro Glu Asp Thr Ala Leu Tyr Tyr Cys Ala Arg
                20                  25                  30

<210>  82
<211>  32
<212>  PRT
<213>  Artificial Sequence

<220>
<223>  GLEW-class Nanobody FW3 sequence

<400>  82

Arg Phe Thr Ser Ser Arg Asp Asn Ala Lys Ser Thr Leu Tyr Leu Gln
1               5                   10                  15
```

FIGURE 10 Continued...

```
Met Asn Asp Leu Lys Pro Glu Asp Thr Ala Leu Tyr Tyr Cys Ala Arg
            20                  25                  30

<210>  83
<211>  32
<212>  PRT
<213>  Artificial Sequence

<220>
<223>  GLEW-class Nanobody FW3 sequence

<400>  83

Arg Phe Ile Ile Ser Arg Asp Asn Ala Lys Asn Thr Leu Tyr Leu Gln
1               5                   10                  15

Met Asn Ser Leu Gly Pro Glu Asp Thr Ala Met Tyr Tyr Cys Gln Arg
            20                  25                  30

<210>  84
<211>  32
<212>  PRT
<213>  Artificial Sequence

<220>
<223>  GLEW-class Nanobody FW3 sequence

<400>  84

Arg Phe Thr Ala Ser Arg Asp Asn Ala Lys Asn Thr Leu Tyr Leu Gln
1               5                   10                  15

Met Asn Ser Leu Lys Ser Glu Asp Thr Ala Arg Tyr Tyr Cys Ala Arg
            20                  25                  30

<210>  85
<211>  32
<212>  PRT
<213>  Artificial Sequence

<220>
<223>  GLEW-class Nanobody FW3 sequence

<400>  85

Arg Phe Thr Ile Ser Arg Asp Asn Ala Lys Asn Thr Leu Tyr Leu Gln
1               5                   10                  15

Met Asp Asp Leu Gln Ser Glu Asp Thr Ala Met Tyr Tyr Cys Gly Arg
            20                  25                  30

<210>  86
<211>  11
<212>  PRT
```

FIGURE 10 Continued...

```
<213>  Artificial Sequence

<220>
<223>  GLEW-class Nanobody FW4 sequence

<400>  86

Gly Ser Gln Gly Thr Gln Val Thr Val Ser Ser
1               5                   10

<210>  87
<211>  11
<212>  PRT
<213>  Artificial Sequence

<220>
<223>  GLEW-class Nanobody FW4 sequence

<400>  87

Leu Arg Gly Gly Thr Gln Val Thr Val Ser Ser
1               5                   10

<210>  88
<211>  11
<212>  PRT
<213>  Artificial Sequence

<220>
<223>  GLEW-class Nanobody FW4 sequence

<400>  88

Arg Gly Gln Gly Thr Leu Val Thr Val Ser Ser
1               5                   10

<210>  89
<211>  11
<212>  PRT
<213>  Artificial Sequence

<220>
<223>  GLEW-class Nanobody FW4 sequence

<400>  89

Arg Ser Arg Gly Ile Gln Val Thr Val Ser Ser
1               5                   10

<210>  90
<211>  11
<212>  PRT
<213>  Artificial Sequence

<220>
<223>  GLEW-class Nanobody FW4 sequence
```

Trp Gly Lys Gly Thr Gln Val Thr Val Ser Ser
1               5                   10

<210> 91
<211> 11
<212> PRT
<213> Artificial Sequence

<220>
<223> GLEW-class Nanobody FW4 sequence

<400> 91

Trp Gly Gln Gly Thr Gln Val Thr Val Ser Ser
1               5                   10

<210> 92
<211> 30
<212> PRT
<213> Artificial Sequence

<220>
<223> P,R,S 103-class Nanobody FW1 sequence

<400> 92

Ala Val Gln Leu Val Glu Ser Gly Gly Gly Leu Val Gln Ala Gly Gly
1               5                   10                  15

Ser Leu Arg Leu Ser Cys Ala Ala Ser Gly Arg Thr Phe Ser
            20                  25                  30

<210> 93
<211> 30
<212> PRT
<213> Artificial Sequence

<220>
<223> P,R,S 103-class Nanobody FW1 sequence

<400> 93

Gln Val Gln Leu Gln Glu Ser Gly Gly Gly Met Val Gln Pro Gly Gly
1               5                   10                  15

Ser Leu Arg Leu Ser Cys Ala Ala Ser Gly Phe Asp Phe Gly
            20                  25                  30

<210> 94
<211> 30
<212> PRT
<213> Artificial Sequence
```

FIGURE 10 Continued...

```
<220>
<223>   P,R,S 103-class Nanobody FW1 sequence

<400>   94

Glu Val His Leu Val Glu Ser Gly Gly Gly Leu Val Arg Pro Gly Gly
1               5                   10                  15

Ser Leu Arg Leu Ser Cys Ala Ala Phe Gly Phe Ile Phe Lys
            20                  25                  30

<210>   95
<211>   30
<212>   PRT
<213>   Artificial Sequence

<220>
<223>   P,R,S 103-class Nanobody FW1 sequence

<400>   95

Gln Val Gln Leu Ala Glu Ser Gly Gly Gly Leu Val Gln Pro Gly Gly
1               5                   10                  15

Ser Leu Lys Leu Ser Cys Ala Ala Ser Arg Thr Ile Val Ser
            20                  25                  30

<210>   96
<211>   30
<212>   PRT
<213>   Artificial Sequence

<220>
<223>   P,R,S 103-class Nanobody FW1 sequence

<400>   96

Gln Glu His Leu Val Glu Ser Gly Gly Gly Leu Val Asp Ile Gly Gly
1               5                   10                  15

Ser Leu Arg Leu Ser Cys Ala Ala Ser Glu Arg Ile Phe Ser
            20                  25                  30

<210>   97
<211>   30
<212>   PRT
<213>   Artificial Sequence

<220>
<223>   P,R,S 103-class Nanobody FW1 sequence

<400>   97

Gln Val Lys Leu Glu Glu Ser Gly Gly Gly Leu Ala Gln Pro Gly Gly
1               5                   10                  15
```

FIGURE 10 Continued...

```
Ser Leu Arg Leu Ser Cys Val Ala Ser Gly Phe Thr Phe Ser
            20                  25                  30

<210>  98
<211>  30
<212>  PRT
<213>  Artificial Sequence

<220>
<223>  P,R,S 103-class Nanobody FW1 sequence

<400>  98

Glu Val Gln Leu Val Glu Ser Gly Gly Gly Leu Val Gln Pro Gly Gly
1               5                   10                  15

Ser Leu Arg Leu Ser Cys Val Cys Val Ser Ser Gly Cys Thr
            20                  25                  30

<210>  99
<211>  30
<212>  PRT
<213>  Artificial Sequence

<220>
<223>  P,R,S 103-class Nanobody FW1 sequence

<400>  99

Glu Val Gln Leu Val Glu Ser Gly Gly Gly Leu Ala Leu Pro Gly Gly
1               5                   10                  15

Ser Leu Thr Leu Ser Cys Val Phe Ser Gly Ser Thr Phe Ser
            20                  25                  30

<210>  100
<211>  22
<212>  PRT
<213>  Artificial Sequence

<220>
<223>  P,R,S 103-class Nanobody FW1 sequence

<400>  100

Val Glu Ser Gly Gly Gly Leu Val Gln Ala Gly Gly Ser Leu Arg Leu
1               5                   10                  15

Ser Cys Ala Ala Ser Gly
            20

```
<211>  22
<212>  PRT
<213>  Artificial Sequence

<220>
<223>  P,R,S 103-class Nanobody FW1 sequence

<400>  101

Ala Glu Ser Gly Gly Gly Leu Val Gln Pro Gly Gly Ser Leu Lys Leu
1               5                   10                  15

Ser Cys Ala Ala Ser Arg
            20

<210>  102
<211>  14
<212>  PRT
<213>  Artificial Sequence

<220>
<223>  P,R,S 103-class Nanobody FW2 sequence

<400>  102

Trp Phe Arg Gln Ala Pro Gly Lys Glu Arg Glu Phe Val Ala
1               5                   10

<210>  103
<211>  14
<212>  PRT
<213>  Artificial Sequence

<220>
<223>  P,R,S 103-class Nanobody FW2 sequence

<400>  103

Trp Val Arg Gln Ala Pro Gly Lys Val Leu Glu Trp Val Ser
1               5                   10

<210>  104
<211>  14
<212>  PRT
<213>  Artificial Sequence

<220>
<223>  P,R,S 103-class Nanobody FW2 sequence

<400>  104

Trp Val Arg Arg Pro Pro Gly Lys Gly Leu Glu Trp Val Ser
1               5                   10

```
<212>  PRT
<213>  Artificial Sequence

<220>
<223>  P,R,S 103-class Nanobody FW2 sequence

<400>  105

Trp Ile Arg Gln Ala Pro Gly Lys Glu Arg Glu Gly Val Ser
1               5                   10

<210>  106
<211>  14
<212>  PRT
<213>  Artificial Sequence

<220>
<223>  P,R,S 103-class Nanobody FW2 sequence

<400>  106

Trp Val Arg Gln Tyr Pro Gly Lys Glu Pro Glu Trp Val Ser
1               5                   10

<210>  107
<211>  14
<212>  PRT
<213>  Artificial Sequence

<220>
<223>  P,R,S 103-class Nanobody FW2 sequence

<400>  107

Trp Phe Arg Gln Pro Pro Gly Lys Glu His Glu Phe Val Ala
1               5                   10

<210>  108
<211>  14
<212>  PRT
<213>  Artificial Sequence

<220>
<223>  P,R,S 103-class Nanobody FW2 sequence

<400>  108

Trp Tyr Arg Gln Ala Pro Gly Lys Arg Thr Glu Leu Val Ala
1               5                   10

<210>  109
<211>  14
<212>  PRT
<213>  Artificial Sequence

<220>
<223>  P,R,S 103-class Nanobody FW2 sequence
```

Trp Leu Arg Gln Ala Pro Gly Gln Gly Leu Glu Trp Val Ser
1               5                   10

<210>  110
<211>  14
<212>  PRT
<213>  Artificial Sequence

<220>
<223>  P,R,S 103-class Nanobody FW2 sequence

<400>  110

Trp Leu Arg Gln Thr Pro Gly Lys Gly Leu Glu Trp Val Gly
1               5                   10

<210>  111
<211>  14
<212>  PRT
<213>  Artificial Sequence

<220>
<223>  P,R,S 103-class Nanobody FW2 sequence

<400>  111

Trp Val Arg Gln Ala Pro Gly Lys Ala Glu Glu Phe Val Ser
1               5                   10

<210>  112
<211>  32
<212>  PRT
<213>  Artificial Sequence

<220>
<223>  P,R,S 103-class Nanobody FW3 sequence

<400>  112

Arg Phe Thr Ile Ser Arg Asp Asn Ala Lys Asn Thr Val Tyr Leu Gln
1               5                   10                  15

Met Asn Ser Leu Lys Pro Glu Asp Thr Ala Val Tyr Tyr Cys Ala Ala
                20                  25                  30

<210>  113
<211>  32
<212>  PRT
<213>  Artificial Sequence

<220>
<223>  P,R,S 103-class Nanobody FW3 sequence
```

Arg Phe Thr Ile Ser Arg Asp Asn Ala Arg Asn Thr Leu Tyr Leu Gln
1               5                   10                  15

Met Asp Ser Leu Ile Pro Glu Asp Thr Ala Leu Tyr Tyr Cys Ala Arg
                20                  25                  30

<210>  114
<211>  32
<212>  PRT
<213>  Artificial Sequence

<220>
<223>  P,R,S 103-class Nanobody FW3 sequence

<400>  114

Arg Phe Thr Ile Ser Arg Asp Asn Ala Lys Asn Glu Met Tyr Leu Gln
1               5                   10                  15

Met Asn Asn Leu Lys Thr Glu Asp Thr Gly Val Tyr Trp Cys Gly Ala
                20                  25                  30

<210>  115
<211>  32
<212>  PRT
<213>  Artificial Sequence

<220>
<223>  P,R,S 103-class Nanobody FW3 sequence

<400>  115

Arg Phe Thr Ile Ser Ser Asp Ser Asn Arg Asn Met Ile Tyr Leu Gln
1               5                   10                  15

Met Asn Asn Leu Lys Pro Glu Asp Thr Ala Val Tyr Tyr Cys Ala Ala
                20                  25                  30

<210>  116
<211>  32
<212>  PRT
<213>  Artificial Sequence

<220>
<223>  P,R,S 103-class Nanobody FW3 sequence

<400>  116

Arg Phe Thr Ile Ser Arg Asp Asn Ala Lys Asn Met Leu Tyr Leu His
1               5                   10                  15

Leu Asn Asn Leu Lys Ser Glu Asp Thr Ala Val Tyr Tyr Cys Arg Arg
```

<210> 117
        <211> 32
        <212> PRT
        <213> Artificial Sequence

<220>
        <223> P,R,S 103-class Nanobody FW3 sequence

<400> 117

Arg Phe Thr Ile Ser Arg Asp Asn Ala Lys Lys Thr Val Tyr Leu Arg
1               5                   10                  15

Leu Asn Ser Leu Asn Pro Glu Asp Thr Ala Val Tyr Ser Cys Asn Leu
                20                  25                  30

<210> 118
        <211> 32
        <212> PRT
        <213> Artificial Sequence

<220>
        <223> P,R,S 103-class Nanobody FW3 sequence

<400> 118

Arg Phe Lys Ile Ser Arg Asp Asn Ala Lys Lys Thr Leu Tyr Leu Gln
1               5                   10                  15

Met Asn Ser Leu Gly Pro Glu Asp Thr Ala Met Tyr Tyr Cys Gln Arg
                20                  25                  30

<210> 119
        <211> 32
        <212> PRT
        <213> Artificial Sequence

<220>
        <223> P,R,S 103-class Nanobody FW3 sequence

<400> 119

Arg Phe Thr Val Ser Arg Asp Asn Gly Lys Asn Thr Ala Tyr Leu Arg
1               5                   10                  15

Met Asn Ser Leu Lys Pro Glu Asp Thr Ala Asp Tyr Tyr Cys Ala Val
                20                  25                  30

<210> 120
        <211> 11
        <212> PRT
        <213> Artificial Sequence
```

FIGURE 10 Continued...

```
<220>
<223>  P,R,S 103-class Nanobody FW4 sequence

<400>  120

Arg Gly Gln Gly Thr Gln Val Thr Val Ser Ser
1               5                   10

<210>  121
<211>  11
<212>  PRT
<213>  Artificial Sequence

<220>
<223>  P,R,S 103-class Nanobody FW4 sequence

<400>  121

Leu Arg Gly Gly Thr Gln Val Thr Val Ser Ser
1               5                   10

<210>  122
<211>  11
<212>  PRT
<213>  Artificial Sequence

<220>
<223>  P,R,S 103-class Nanobody FW4 sequence

<400>  122

Gly Asn Lys Gly Thr Leu Val Thr Val Ser Ser
1               5                   10

<210>  123
<211>  11
<212>  PRT
<213>  Artificial Sequence

<220>
<223>  P,R,S 103-class Nanobody FW4 sequence

<400>  123

Ser Ser Pro Gly Thr Gln Val Thr Val Ser Ser
1               5                   10

<210>  124
<211>  11
<212>  PRT
<213>  Artificial Sequence

<220>
<223>  P,R,S 103-class Nanobody FW4 sequence

```
Ser Ser Gln Gly Thr Leu Val Thr Val Ser Ser
1               5                   10

<210> 125
<211> 11
<212> PRT
<213> Artificial Sequence

<220>
<223> P,R,S 103-class Nanobody FW4 sequence

<400> 125

Arg Ser Arg Gly Ile Gln Val Thr Val Ser Ser
1               5                   10

<210> 126
<211> 30
<212> PRT
<213> Artificial Sequence

<220>
<223> FR1 sequence

<400> 126

Glu Val Gln Leu Val Glu Ser Gly Gly Gly Leu Val Gln Pro Gly Gly
1               5                   10                  15

Ser Leu Arg Leu Ser Cys Ala Ala Ser Gly Ser Ile Phe Ser
            20                  25                  30

<210> 127
<211> 30
<212> PRT
<213> Artificial Sequence

<220>
<223> FR1 sequence

<400> 127

Glu Val Gln Leu Val Glu Ser Gly Gly Gly Leu Val Gln Ala Gly Asp
1               5                   10                  15

Ser Leu Arg Leu Ser Cys Thr Ala Thr Gly Arg Thr Ser Ser
            20                  25                  30

<210> 128
<211> 30
<212> PRT
<213> Artificial Sequence

```
<223>  FR1 sequence

<400>  128

Glu Val Gln Leu Val Glu Ser Gly Gly Gly Leu Val Gln Ala Gly Gly
1               5                   10                  15

Ser Leu Arg Leu Ser Cys Ala Thr Ser Gly Phe Thr Phe Ser
            20                  25                  30

<210>  129
<211>  30
<212>  PRT
<213>  Artificial Sequence

<220>
<223>  FR1 sequence

<400>  129

Lys Val Gln Leu Val Glu Ser Gly Gly Gly Leu Val Gln Ala Gly Gly
1               5                   10                  15

Ser Leu Arg Leu Ser Cys Ala Ala Ser Gly Arg Thr Phe Ser
            20                  25                  30

<210>  130
<211>  30
<212>  PRT
<213>  Artificial Sequence

<220>
<223>  FR1 sequence

<400>  130

Glu Val Gln Leu Val Glu Ser Gly Gly Gly Leu Val Gln Ala Gly Asp
1               5                   10                  15

Ser Leu Arg Leu Ser Cys Ala Ala Thr Gly Arg Thr Ser Ser
            20                  25                  30

<210>  131
<211>  30
<212>  PRT
<213>  Artificial Sequence

<220>
<223>  FR1 sequence

<400>  131

Glu Val Gln Leu Val Glu Ser Gly Gly Gly Leu Val Gln Ala Gly Gly
1               5                   10                  15
```

FIGURE 10 Continued…

```
Ser Leu Arg Leu Ser Cys Val Ala Ser Gly Arg Thr Leu Arg
            20                  25                  30

<210>  132
<211>  30
<212>  PRT
<213>  Artificial Sequence

<220>
<223>  FR1 sequence

<400>  132

Glu Val Gln Leu Val Glu Ser Gly Gly Gly Leu Val Gln Ala Gly Gly
1               5                   10                  15

Ser Leu Arg Leu Thr Cys Ala Ala Ser Gly Arg Thr Phe Ser
            20                  25                  30

<210>  133
<211>  30
<212>  PRT
<213>  Artificial Sequence

<220>
<223>  FR1 sequence

<400>  133

Glu Val Gln Leu Val Glu Ser Gly Gly Gly Leu Val Gln Ala Gly Gly
1               5                   10                  15

Ser Leu Arg Leu Ser Cys Ala Ala Ser Gly Leu Thr Phe Asn
            20                  25                  30

<210>  134
<211>  30
<212>  PRT
<213>  Artificial Sequence

<220>
<223>  FR1 sequence

<400>  134

Glu Val Gln Leu Val Glu Ser Gly Gly Gly Leu Val Gln Ala Gly Asp
1               5                   10                  15

Ser Leu Arg Leu Ser Cys Ala Ala Thr Gly Arg Thr Ser Ser
            20                  25                  30

```
<212>  PRT
<213>  Artificial Sequence

<220>
<223>  CDR sequence

<400>  135

Asp Asn Val Met Gly
1               5

<210>  136
<211>  5
<212>  PRT
<213>  Artificial Sequence

<220>
<223>  CDR sequence

<400>  136

Ile Tyr Asn Met Asp
1               5

<210>  137
<211>  5
<212>  PRT
<213>  Artificial Sequence

<220>
<223>  CDR sequence

<400>  137

Arg Phe Asp Met Ser
1               5

<210>  138
<211>  5
<212>  PRT
<213>  Artificial Sequence

<220>
<223>  CDR sequence

<400>  138

Ser Tyr Phe Met Gly
1               5

<210>  139
<211>  5
<212>  PRT
<213>  Artificial Sequence

<220>
<223>  CDR sequence
```

Ile Tyr Asn Met Asp
1               5

<210> 140
<211> 5
<212> PRT
<213> Artificial Sequence

<220>
<223> CDR sequence

<400> 140

Arg Tyr Val Thr Gly
1               5

<210> 141
<211> 5
<212> PRT
<213> Artificial Sequence

<220>
<223> CDR sequence

<400> 141

Ser Phe Val Ile Gly
1               5

<210> 142
<211> 5
<212> PRT
<213> Artificial Sequence

<220>
<223> CDR sequence

<400> 142

Gln Tyr Thr Ile Thr
1               5

<210> 143
<211> 5
<212> PRT
<213> Artificial Sequence

<220>
<223> CDR sequence

<400> 143

Ile Tyr Asn Met Asp
1               5
```

FIGURE 10 Continued...

```
<210> 144
<211> 14
<212> PRT
<213> Artificial Sequence

<220>
<223> FR2 sequence

<400> 144

Trp Tyr Arg Gln Ala Pro Gly Lys Gln Arg Glu Leu Val Ala
1               5                   10

<210> 145
<211> 14
<212> PRT
<213> Artificial Sequence

<220>
<223> FR2 sequence

<400> 145

Trp Phe Arg Gln Thr Pro Gly Lys Glu Arg Glu Leu Ile Ala
1               5                   10

<210> 146
<211> 14
<212> PRT
<213> Artificial Sequence

<220>
<223> FR2 sequence

<400> 146

Trp Phe Arg Gln Ala Pro Gly Lys Gln Arg Glu Phe Ile Ala
1               5                   10

<210> 147
<211> 14
<212> PRT
<213> Artificial Sequence

<220>
<223> FR2 sequence

<400> 147

Trp Phe Arg Gln Ala Pro Gly Lys Glu Arg Glu Val Val Ala
1               5                   10

<210> 148
<211> 14
<212> PRT
```

FIGURE 10 Continued...

```
<213>  Artificial Sequence

<220>
<223>  FR2 sequence

<400>  148

Trp Phe Leu Gln Ala Pro Gly Lys Glu Arg Glu Leu Ile Ala
1               5                   10

<210>  149
<211>  14
<212>  PRT
<213>  Artificial Sequence

<220>
<223>  FR2 sequence

<400>  149

Trp Phe Arg Gln Ala Pro Gly Lys Glu Arg Glu Val Val Ala
1               5                   10

<210>  150
<211>  14
<212>  PRT
<213>  Artificial Sequence

<220>
<223>  FR2 sequence

<400>  150

Trp Phe Arg Gln Ala Pro Gly Lys Glu Arg Glu Val Val Ala
1               5                   10

<210>  151
<211>  14
<212>  PRT
<213>  Artificial Sequence

<220>
<223>  FR2 sequence

<400>  151

Trp Phe Arg Gln Ala Pro Gly Lys Glu Arg Glu Phe Val Ala
1               5                   10

<210>  152
<211>  14
<212>  PRT
<213>  Artificial Sequence

<220>
<223>  FR2 sequence
```

Trp Phe Arg Gln Gly Ser Gly Lys Gly Arg Glu Leu Ile Ala
1               5                   10

<210>  153
<211>  16
<212>  PRT
<213>  Artificial Sequence

<220>
<223>  CDR sequence

<400>  153

Thr Ile Trp Ser Ser Gly His Thr Asn Tyr Ala Asp Ser Val Lys Gly
1               5                   10                  15

<210>  154
<211>  17
<212>  PRT
<213>  Artificial Sequence

<220>
<223>  CDR sequence

<400>  154

Arg Leu Trp Trp Arg Ser Gly Ser Thr Tyr Tyr Ala Asp Ser Val Lys
1               5                   10                  15

Gly

<210>  155
<211>  16
<212>  PRT
<213>  Artificial Sequence

<220>
<223>  CDR sequence

<400>  155

Thr Ile Phe Ser Gly Gly Asp Thr Asp Tyr Ile Asp Ser Val Lys Gly
1               5                   10                  15

<210>  156
<211>  17
<212>  PRT
<213>  Artificial Sequence

<220>
<223>  CDR sequence

```
Thr Ile Arg Trp Ser Asp Gly Ser Thr Tyr Tyr Glu Asp Ser Val Lys
1               5                   10                  15

Gly

<210>  157
<211>  17
<212>  PRT
<213>  Artificial Sequence

<220>
<223>  CDR sequence

<400>  157

Arg Ile Trp Trp Arg Ser Gly Ala Thr Tyr Tyr Ala Asp Ser Val Lys
1               5                   10                  15

Gly

<210>  158
<211>  17
<212>  PRT
<213>  Artificial Sequence

<220>
<223>  CDR sequence

<400>  158

Ser Ile Ser Trp Ser Gly Glu Ser Thr Tyr Tyr Ala Asp Ser Val Lys
1               5                   10                  15

Gly

<210>  159
<211>  16
<212>  PRT
<213>  Artificial Sequence

<220>
<223>  CDR sequence

<400>  159

Ser Ile Thr Ser Gly Gly Ser Thr Tyr Tyr Glu Asp Ser Gly Lys Gly
1               5                   10                  15

```
<212>  PRT
<213>  Artificial Sequence

<220>
<223>  CDR sequence

<400>  160

Ala Val Ser Trp Ser Gly Ser Ser Glu Ser Val Ser Asn Ser Val Lys
1               5                   10                  15

Gly

<210>  161
<211>  17
<212>  PRT
<213>  Artificial Sequence

<220>
<223>  CDR sequence

<400>  161

Arg Ile Trp Trp Arg Ser Gly Glu Thr Tyr Tyr Ala Asp Ser Val Lys
1               5                   10                  15

Gly

<210>  162
<211>  32
<212>  PRT
<213>  Artificial Sequence

<220>
<223>  FR3 sequence

<400>  162

Arg Phe Thr Ile Ser Arg Asp Asn Ala Lys Asn Thr Val Tyr Leu Gln
1               5                   10                  15

Met Asn Ser Leu Lys Pro Glu Asp Thr Ala Val Tyr Tyr Cys Asn Leu
                20                  25                  30

<210>  163
<211>  32
<212>  PRT
<213>  Artificial Sequence

<220>
<223>  FR3 sequence

```
Arg Phe Thr Ile Ser Arg Asp Asn Ala Lys Asn Thr Val Tyr Leu Gln
1               5                   10                  15

Met Asn Ser Leu Lys Pro Glu Asp Thr Ser Val Tyr Ile Cys Thr Ala
            20                  25                  30

<210>   164
<211>   32
<212>   PRT
<213>   Artificial Sequence

<220>
<223>   FR3 sequence

<400>   164

Arg Phe Thr Ile Ser Arg Asp Asn Ala Lys Asn Thr Val Tyr Leu Gln
1               5                   10                  15

Met Asn Ser Leu Lys Pro Glu Asp Thr Ala Val Tyr Tyr Cys Cys Pro
            20                  25                  30

<210>   165
<211>   32
<212>   PRT
<213>   Artificial Sequence

<220>
<223>   FR3 sequence

<400>   165

Arg Phe Thr Ile Ser Arg Asp Asn Ala Lys Asn Thr Val Tyr Leu Gln
1               5                   10                  15

Met Asn Ser Leu Lys Pro Glu Asp Thr Ala Val Tyr Tyr Cys Ala Ala
            20                  25                  30

<210>   166
<211>   32
<212>   PRT
<213>   Artificial Sequence

<220>
<223>   FR3 sequence

<400>   166

Arg Phe Thr Ile Ser Arg Gly Asn Ala Lys Asn Thr Val Tyr Leu Gln
1               5                   10                  15

Met Asn Ser Leu Lys Pro Glu Asp Thr Gly Val Tyr His Cys Thr Ala
            20                  25                  30
```

FIGURE 10 Continued...

```
<210>  167
<211>  32
<212>  PRT
<213>  Artificial Sequence

<220>
<223>  FR3 sequence

<400>  167
```

Arg Phe Ala Ile Ser Arg Asp Asn Ala Lys Asn Ala Val Tyr Leu Gln
1               5                   10                  15

Met Asn Ser Leu Asn Leu Glu Asp Thr Gly Val Tyr Tyr Cys Ala Glu
            20                  25                  30

```
<210>  168
<211>  32
<212>  PRT
<213>  Artificial Sequence

<220>
<223>  FR3 sequence

<400>  168
```

Arg Phe Thr Ile Ser Arg Asp Asn Ala Lys Asn Arg Val Tyr Leu Gln
1               5                   10                  15

Met Asn Ser Leu Arg Pro Glu Asp Thr Ala Val Tyr Tyr Cys Ala Ala
            20                  25                  30

```
<210>  169
<211>  32
<212>  PRT
<213>  Artificial Sequence

<220>
<223>  FR3 sequence

<400>  169
```

Arg Phe Thr Ile Ser Arg Asp Asn Ala Lys Asn Thr Ala Tyr Leu Ala
1               5                   10                  15

Met Asn Ser Leu Lys Pro Glu Asp Thr Ala Val Tyr Tyr Cys Ala Ala
            20                  25                  30

```
<210>  170
<211>  32
<212>  PRT
<213>  Artificial Sequence
```

FIGURE 10 Continued...

```
<220>
<223>  FR3 sequence

<400>  170

Arg Phe Thr Ile Ser Arg Asp Asn Ala Lys Asn Thr Val Tyr Leu Gln
1               5                   10                  15

Met Asn Ser Leu Lys Pro Glu Asp Thr Asn Val Tyr His Cys Ala Ala
                20                  25                  30

<210>  171
<211>  12
<212>  PRT
<213>  Artificial Sequence

<220>
<223>  CDR sequence

<400>  171

Gly Thr Ile Val Thr Gly Thr Trp Arg Ser Asp Tyr
1               5                   10

<210>  172
<211>  10
<212>  PRT
<213>  Artificial Sequence

<220>
<223>  CDR sequence

<400>  172

Gly Asp Thr Gly Gly Ala Ala Tyr Gly Tyr
1               5                   10

<210>  173
<211>  6
<212>  PRT
<213>  Artificial Sequence

<220>
<223>  CDR sequence

<400>  173

Leu Gly Ile Glu Tyr Ala
1               5

<210>  174
<211>  9
<212>  PRT
<213>  Artificial Sequence

```
<223>  CDR sequence

<400>  174

Ala Lys Gly Ile Gly Val Tyr Gly Tyr
1               5

<210>  175
<211>  10
<212>  PRT
<213>  Artificial Sequence

<220>
<223>  CDR sequence

<400>  175

Gly Val Thr Gly Gly Ala Ala Tyr Gly Tyr
1               5                   10

<210>  176
<211>  9
<212>  PRT
<213>  Artificial Sequence

<220>
<223>  CDR sequence

<400>  176

Ala Glu Leu Pro Gly Thr Tyr Asp Tyr
1               5

<210>  177
<211>  9
<212>  PRT
<213>  Artificial Sequence

<220>
<223>  CDR sequence

<400>  177

Ala Glu Pro Ala Gly Val Tyr Asp Val
1               5

<210>  178
<211>  15
<212>  PRT
<213>  Artificial Sequence

<220>
<223>  CDR sequence

<400>  178

Asp Arg Arg Gly Leu Ala Ser Thr Arg Ala Ala Asp Tyr Asp Tyr
```

<210>   179
        <211>   10
        <212>   PRT
        <213>   Artificial Sequence <220>
        <223>   CDR sequence

<400>   179

Gly Asp Thr Gly Gly Ala Ser Tyr Gly Tyr
        1               5                       10

<210>   180
        <211>   11
        <212>   PRT
        <213>   Artificial Sequence <220>
        <223>   FR4 sequence

<400>   180

Trp Gly Gln Gly Thr Gln Val Thr Val Ser Ser
        1               5                       10

<210>   181
        <211>   11
        <212>   PRT
        <213>   Artificial Sequence <220>
        <223>   FR4 sequence

<400>   181

Trp Gly Gln Gly Thr Gln Val Thr Val Ser Ser
        1               5                       10

<210>   182
        <211>   11
        <212>   PRT
        <213>   Artificial Sequence <220>
        <223>   FR4 sequence

<400>   182

Trp Gly Gln Gly Thr Gln Val Thr Val Ser Ser
        1               5                       10

```
<212>  PRT
<213>  Artificial Sequence

<220>
<223>  FR4 sequence

<400>  183

Trp Gly Gln Gly Thr Gln Val Thr Val Ser Ser
1               5                   10

<210>  184
<211>  11
<212>  PRT
<213>  Artificial Sequence

<220>
<223>  FR4 sequence

<400>  184

Trp Gly Gln Gly Thr Gln Val Thr Val Ser Ser
1               5                   10

<210>  185
<211>  11
<212>  PRT
<213>  Artificial Sequence

<220>
<223>  FR4 sequence

<400>  185

Trp Gly Gln Gly Thr Gln Val Thr Val Ser Ser
1               5                   10

<210>  186
<211>  11
<212>  PRT
<213>  Artificial Sequence

<220>
<223>  FR4 sequence

<400>  186

Trp Gly Gln Gly Thr Gln Val Thr Val Ser Ser
1               5                   10

<210>  187
<211>  11
<212>  PRT
<213>  Artificial Sequence

<220>
<223>  FR4 sequence
```

Trp Gly Gln Gly Thr Gln Val Thr Val Ser Ser
1               5                   10

<210> 188
<211> 11
<212> PRT
<213> Artificial Sequence

<220>
<223> FR4 sequence

<400> 188

Trp Gly Gln Gly Thr Gln Val Thr Val Ser Ser
1               5                   10

<210> 189
<211> 120
<212> PRT
<213> Artificial Sequence

<220>
<223> Nanobody

<400> 189

Glu Val Gln Leu Val Glu Ser Gly Gly Gly Leu Val Gln Pro Gly Gly
1               5                   10                  15

Ser Leu Arg Leu Ser Cys Ala Ala Ser Gly Ser Ile Phe Ser Asp Asn
                20                  25                  30

Val Met Gly Trp Tyr Arg Gln Ala Pro Gly Lys Gln Arg Glu Leu Val
            35                  40                  45

Ala Thr Ile Trp Ser Ser Gly His Thr Asn Tyr Ala Asp Ser Val Lys
        50                  55                  60

Gly Arg Phe Thr Ile Ser Arg Asp Asn Ala Lys Asn Thr Val Tyr Leu
65                  70                  75                  80

Gln Met Asn Ser Leu Lys Pro Glu Asp Thr Ala Val Tyr Tyr Cys Asn
                85                  90                  95

Leu Gly Thr Ile Val Thr Gly Thr Trp Arg Ser Asp Tyr Trp Gly Gln
                100                 105                 110

Gly Thr Gln Val Thr Val Ser Ser
            115                 120

FIGURE 10 Continued...

```
<210>  190
<211>  119
<212>  PRT
<213>  Artificial Sequence

<220>
<223>  Nanobody

<400>  190
```

Glu Val Gln Leu Val Glu Ser Gly Gly Gly Leu Val Gln Ala Gly Asp
1               5                   10                  15

Ser Leu Arg Leu Ser Cys Thr Ala Thr Gly Arg Thr Ser Ser Ile Tyr
            20                  25                  30

Asn Met Asp Trp Phe Arg Gln Thr Pro Gly Lys Glu Arg Glu Leu Ile
        35                  40                  45

Ala Arg Leu Trp Trp Arg Ser Gly Ser Thr Tyr Tyr Ala Asp Ser Val
    50                  55                  60

Lys Gly Arg Phe Thr Ile Ser Arg Asp Asn Ala Lys Asn Thr Val Tyr
65                  70                  75                  80

Leu Gln Met Asn Ser Leu Lys Pro Glu Asp Thr Ser Val Tyr Ile Cys
            85                  90                  95

Thr Ala Gly Asp Thr Gly Gly Ala Ala Tyr Gly Tyr Trp Gly Gln Gly
            100                 105                 110

Thr Gln Val Thr Val Ser Ser
            115

```
<210>  191
<211>  114
<212>  PRT
<213>  Artificial Sequence

<220>
<223>  Nanobody

<400>  191
```

Glu Val Gln Leu Val Glu Ser Gly Gly Gly Leu Val Gln Ala Gly Gly
1               5                   10                  15

Ser Leu Arg Leu Ser Cys Ala Thr Ser Gly Phe Thr Phe Ser Arg Phe
            20                  25                  30

FIGURE 10 Continued...

```
Asp Met Ser Trp Phe Arg Gln Ala Pro Gly Lys Gln Arg Glu Phe Ile
        35                  40                  45

Ala Thr Ile Phe Ser Gly Gly Asp Thr Asp Tyr Ile Asp Ser Val Lys
        50                  55                  60

Gly Arg Phe Thr Ile Ser Arg Asp Asn Ala Lys Asn Thr Val Tyr Leu
65                      70                  75                  80

Gln Met Asn Ser Leu Lys Pro Glu Asp Thr Ala Val Tyr Tyr Cys Cys
                85                  90                      95

Pro Leu Gly Ile Glu Tyr Ala Trp Gly Gln Gly Thr Gln Val Thr Val
                100                 105                 110

Ser Ser

<210>  192
<211>  118
<212>  PRT
<213>  Artificial Sequence

<220>
<223>  Nanobody

<400>  192

Lys Val Gln Leu Val Glu Ser Gly Gly Gly Leu Val Gln Ala Gly Gly
1               5                   10                  15

Ser Leu Arg Leu Ser Cys Ala Ala Ser Gly Arg Thr Phe Ser Ser Tyr
                20                  25                  30

Phe Met Gly Trp Phe Arg Gln Ala Pro Gly Lys Glu Arg Glu Val Val
        35                  40                  45

Ala Thr Ile Arg Trp Ser Asp Gly Ser Thr Tyr Tyr Glu Asp Ser Val
        50                  55                  60

Lys Gly Arg Phe Thr Ile Ser Arg Asp Asn Ala Lys Asn Thr Val Tyr
65                      70                  75                  80

Leu Gln Met Asn Ser Leu Lys Pro Glu Asp Thr Ala Val Tyr Tyr Cys
                85                  90                      95

Ala Ala Ala Lys Gly Ile Gly Val Tyr Gly Tyr Trp Gly Gln Gly Thr
                100                 105                 110
```

FIGURE 10 Continued...

```
Gln Val Thr Val Ser Ser
        115

<210>   193
<211>   119
<212>   PRT
<213>   Artificial Sequence

<220>
<223>   Nanobody

<400>   193

Glu Val Gln Leu Val Glu Ser Gly Gly Gly Leu Val Gln Ala Gly Asp
1               5                   10                  15

Ser Leu Arg Leu Ser Cys Ala Ala Thr Gly Arg Thr Ser Ser Ile Tyr
            20                  25                  30

Asn Met Asp Trp Phe Leu Gln Ala Pro Gly Lys Glu Arg Glu Leu Ile
        35                  40                  45

Ala Arg Ile Trp Trp Arg Ser Gly Ala Thr Tyr Tyr Ala Asp Ser Val
    50                  55                  60

Lys Gly Arg Phe Thr Ile Ser Arg Gly Asn Ala Lys Asn Thr Val Tyr
65                  70                  75                  80

Leu Gln Met Asn Ser Leu Lys Pro Glu Asp Thr Gly Val Tyr His Cys
                85                  90                  95

Thr Ala Gly Val Thr Gly Gly Ala Ala Tyr Gly Tyr Trp Gly Gln Gly
            100                 105                 110

Thr Gln Val Thr Val Ser Ser
        115

<210>   194
<211>   118
<212>   PRT
<213>   Artificial Sequence

<220>
<223>   Nanobody

<400>   194

Glu Val Gln Leu Val Glu Ser Gly Gly Gly Leu Val Gln Ala Gly Gly
1               5                   10                  15
```

FIGURE 10 Continued...

```
Ser Leu Arg Leu Ser Cys Val Ala Ser Gly Arg Thr Leu Arg Arg Tyr
        20                  25                  30

Val Thr Gly Trp Phe Arg Gln Ala Pro Gly Lys Glu Arg Glu Val Val
        35                  40                  45

Ala Ser Ile Ser Trp Ser Gly Glu Ser Thr Tyr Tyr Ala Asp Ser Val
        50                  55                  60

Lys Gly Arg Phe Ala Ile Ser Arg Asp Asn Ala Lys Asn Ala Val Tyr
65                  70                  75                  80

Leu Gln Met Asn Ser Leu Asn Leu Glu Asp Thr Gly Val Tyr Tyr Cys
                85                  90                  95

Ala Glu Ala Glu Leu Pro Gly Thr Tyr Asp Tyr Trp Gly Gln Gly Thr
                100                 105                 110

Gln Val Thr Val Ser Ser
                115

<210>  195
<211>  117
<212>  PRT
<213>  Artificial Sequence

<220>
<223>  Nanobody

<400>  195

Glu Val Gln Leu Val Glu Ser Gly Gly Gly Leu Val Gln Ala Gly Gly
1               5                   10                  15

Ser Leu Arg Leu Thr Cys Ala Ala Ser Gly Arg Thr Phe Ser Ser Phe
        20                  25                  30

Val Ile Gly Trp Phe Arg Gln Ala Pro Gly Lys Gln Arg Glu Val Val
        35                  40                  45

Ala Ser Ile Thr Ser Gly Gly Ser Thr Tyr Tyr Glu Asp Ser Gly Lys
        50                  55                  60

Gly Arg Phe Thr Ile Ser Arg Asp Asn Ala Lys Asn Arg Val Tyr Leu
65                  70                  75                  80

Gln Met Asn Ser Leu Arg Pro Glu Asp Thr Ala Val Tyr Tyr Cys Ala
                85                  90                  95
```

FIGURE 10 Continued...

Ala Ala Glu Pro Ala Gly Val Tyr Asp Val Trp Gly Gln Gly Thr Gln
            100             105                 110

Val Thr Val Ser Ser
        115

<210> 196
<211> 124
<212> PRT
<213> Artificial Sequence

<220>
<223> Nanobody

<400> 196

Glu Val Gln Leu Val Glu Ser Gly Gly Gly Leu Val Gln Ala Gly Gly
1               5                   10                  15

Ser Leu Arg Leu Ser Cys Ala Ala Ser Gly Leu Thr Phe Asn Gln Tyr
            20                  25                  30

Thr Ile Thr Trp Phe Arg Gln Ala Pro Gly Lys Glu Arg Glu Phe Val
        35                  40                  45

Ala Ala Val Ser Trp Ser Gly Ser Ser Glu Ser Val Ser Asn Ser Val
        50                  55                  60

Lys Gly Arg Phe Thr Ile Ser Arg Asp Asn Ala Lys Asn Thr Ala Tyr
65                  70                  75                  80

Leu Ala Met Asn Ser Leu Lys Pro Glu Asp Thr Ala Val Tyr Tyr Cys
                85                  90                  95

Ala Ala Asp Arg Arg Gly Leu Ala Ser Thr Arg Ala Ala Asp Tyr Asp
            100                 105                 110

Tyr Trp Gly Gln Gly Thr Gln Val Thr Val Ser Ser
            115                 120

<210> 197
<211> 119
<212> PRT
<213> Artificial Sequence

<220>
<223> Nanobody

```
Glu Val Gln Leu Val Glu Ser Gly Gly Gly Leu Val Gln Ala Gly Asp
1               5                   10                  15

Ser Leu Arg Leu Ser Cys Ala Ala Thr Gly Arg Thr Ser Ser Ile Tyr
            20                  25                  30

Asn Met Asp Trp Phe Arg Gln Gly Ser Gly Lys Gly Arg Glu Leu Ile
        35                  40                  45

Ala Arg Ile Trp Trp Arg Ser Gly Glu Thr Tyr Tyr Ala Asp Ser Val
    50                  55                  60

Lys Gly Arg Phe Thr Ile Ser Arg Asp Asn Ala Lys Asn Thr Val Tyr
65                  70                  75                  80

Leu Gln Met Asn Ser Leu Lys Pro Glu Asp Thr Asn Val Tyr His Cys
                85                  90                  95

Ala Ala Gly Asp Thr Gly Gly Ala Ser Tyr Gly Tyr Trp Gly Gln Gly
            100                 105                 110

Thr Gln Val Thr Val Ser Ser
            115
```

<210> 198
<211> 213
<212> PRT
<213> Homo sapiens

<400> 198

```
Met Gln Leu Pro Leu Ala Leu Cys Leu Val Cys Leu Leu Val His Thr
1               5                   10                  15

Ala Phe Arg Val Val Glu Gly Gln Gly Trp Gln Ala Phe Lys Asn Asp
            20                  25                  30

Ala Thr Glu Ile Ile Pro Glu Leu Gly Glu Tyr Pro Glu Pro Pro Pro
            35                  40                  45

Glu Leu Glu Asn Asn Lys Thr Met Asn Arg Ala Glu Asn Gly Gly Arg
            50                  55                  60

Pro Pro His His Pro Phe Glu Thr Lys Asp Val Ser Glu Tyr Ser Cys
65                  70                  75                  80

Arg Glu Leu His Phe Thr Arg Tyr Val Thr Asp Gly Pro Cys Arg Ser
```

Ala Lys Pro Val Thr Glu Leu Val Cys Ser Gly Gln Cys Gly Pro Ala
                100                 105                 110

Arg Leu Leu Pro Asn Ala Ile Gly Arg Gly Lys Trp Trp Arg Pro Ser
                115                 120                 125

Gly Pro Asp Phe Arg Cys Ile Pro Asp Arg Tyr Arg Ala Gln Thr Val
                130                 135                 140

Gln Leu Leu Cys Pro Gly Gly Glu Ala Pro Arg Ala Arg Lys Val Arg
    145                 150                 155                 160

Leu Val Ala Ser Cys Lys Cys Lys Arg Leu Thr Arg Phe His Asn Gln
                165                 170                 175

Ser Glu Leu Lys Asp Phe Gly Thr Glu Ala Ala Arg Pro Gln Lys Gly
                180                 185                 190

Arg Lys Pro Arg Pro Arg Ala Arg Ser Ala Lys Ala Asn Gln Ala Glu
                195                 200                 205

Leu Glu Asn Ala Tyr
                210

<210>  199
<211>  213
<212>  PRT
<213>  Artificial Sequence

<220>
<223>  Recombinant sclerostin

<400>  199

Met Pro Leu Leu Leu Leu Leu Pro Leu Leu Trp Ala Gly Ala Leu Ala
    1               5                   10                  15

His His His His His His His Gln Gly Trp Gln Ala Phe Lys Asn Asp
                20                  25                  30

Ala Thr Glu Ile Ile Pro Glu Leu Gly Glu Tyr Pro Glu Pro Pro Pro
                35                  40                  45

Glu Leu Glu Asn Asn Lys Thr Met Asn Arg Ala Glu Asn Gly Gly Arg
    50                  55                  60
```

FIGURE 10 Continued...

```
Pro Pro His His Pro Phe Glu Thr Lys Asp Val Ser Glu Tyr Ser Cys
65          70              75                  80

Arg Glu Leu His Phe Thr Arg Tyr Val Thr Asp Gly Pro Cys Arg Ser
            85              90                  95

Ala Lys Pro Val Thr Glu Leu Val Cys Ser Gly Gln Cys Gly Pro Ala
            100             105                 110

Arg Leu Leu Pro Asn Ala Ile Gly Arg Gly Lys Trp Trp Arg Pro Ser
            115             120                 125

Gly Pro Asp Phe Arg Cys Ile Pro Asp Arg Tyr Arg Ala Gln Arg Val
    130             135                 140

Gln Leu Leu Cys Pro Gly Gly Glu Ala Pro Arg Ala Arg Lys Val Arg
145             150                 155                 160

Leu Val Ala Ser Cys Lys Cys Lys Arg Leu Thr Arg Phe His Asn Gln
                165             170                 175

Ser Glu Leu Lys Asp Phe Gly Thr Glu Ala Ala Arg Pro Gln Lys Gly
            180             185                 190

Arg Lys Pro Arg Pro Arg Ala Arg Ser Ala Lys Ala Asn Gln Ala Glu
        195             200                 205

Leu Glu Asn Ala Tyr
        210
```

TREATMENT FOR BONE DISEASES

CROSS-REFERENCE TO RELATED APPLICATIONS AND INCORPORATION BY REFERENCE

This application claims priority to U.S. Provisional Patent Application No. 61/668,210, filed Jul. 5, 2012, and U.S. Provisional Patent Application No. 61/782,072, filed Mar. 14, 2013, the disclosures of which are hereby incorporated by reference in their entirety.

The following applications are hereby incorporated by reference in their entirety: U.S. patent application Ser. No. 11/410,540 (issued as U.S. Pat. No. 8,003,108), filed Apr. 25, 2006, which claims priority to U.S. Provisional Patent Application No. 60/792,645, filed Apr. 17, 2006, U.S. Provisional Patent Application No. 60/782,244, filed Mar. 13, 2006, U.S. Provisional Patent Application No. 60/776,847, filed Feb. 24, 2006, and U.S. Provisional Patent Application No. 60/677,583, filed May 3, 2005; and U.S. patent application Ser. No. 11/411,003 (issued as U.S. Pat. No. 7,592,429), filed Apr. 25, 2006, which claims priority to U.S. Provisional Patent Application No. 60/792,645, filed Apr. 17, 2006, U.S. Provisional Patent Application No. 60/782,244, filed Mar. 13, 2006, U.S. Provisional Patent Application No. 60/776,847, filed Feb. 24, 2006, and U.S. Provisional Patent Application No. 60/677,583, filed May 3, 2005. The following applications also are hereby incorporated by reference: U.S. Provisional Patent Application No. 61/668,210, filed Jul. 5, 2012; U.S. patent application Ser. No. 12/212,327 (issued as U.S. Pat. No. 8,017,120), filed Sep. 17, 2008, which claims priority to U.S. Provisional Patent Application No. 60/973,024, filed Sep. 17, 2007; and U.S. patent application Ser. No. 12/811,171, filed Jun. 29, 2010, which is a U.S. National Phase Application pursuant to 35 U.S.C. § 371 of International Patent Application No. PCT/US08/86864, filed on Dec. 15, 2008, which claims priority to U.S. Provisional Patent Application No. 61/013,917, filed Dec. 14, 2007.

TECHNICAL FIELD OF THE INVENTION

The invention generally relates to methods of treating bone disorders using anti-sclerostin antibodies.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: ASCII (text) file named "40016B SubSeqListing.txt,"800,957 bytes, created on Oct. 3, 2013.

BACKGROUND OF THE INVENTION

Loss of bone mineral content can be caused by a wide variety of conditions and may result in significant medical problems. For example, osteoporosis is a debilitating disease in humans and is characterized by marked decreases in skeletal bone mass and mineral density, structural deterioration of bone, including degradation of bone microarchitecture and corresponding increases in bone fragility (i.e., decreases in bone strength), and susceptibility to fracture in afflicted individuals. Osteoporosis in humans is generally preceded by clinical osteopenia (bone mineral density that is greater than one standard deviation but less than 2.5 standard deviations below the mean value for young adult bone), a condition found in approximately 25 million people in the United States. Another 7-8 million patients in the United States have been diagnosed with clinical osteoporosis (defined as bone mineral content greater than 2.5 standard deviations below that of mature young adult bone). The frequency of osteoporosis in the human population increases with age. Among Caucasians, osteoporosis is predominant in women who, in the United States, comprise 80% of the osteoporosis patient pool. The increased fragility and susceptibility to fracture of skeletal bone in the aged is aggravated by the greater risk of accidental falls in this population. Fractured hips, wrists, and vertebrae are among the most common injuries associated with osteoporosis. Hip fractures in particular are extremely uncomfortable and expensive for the patient, and for women, correlate with high rates of mortality and morbidity.

SUMMARY OF THE INVENTION

The summary below is not intended to define every aspect of the invention, and additional aspects are described in other sections, such as the Detailed Description. The entire document is intended to be related as a unified disclosure, and it should be understood that all combinations of features described herein are contemplated, even if the combination of features are not found together in the same sentence, or paragraph, or section of this document. With respect to aspects of the invention described or claimed with "a" or "an," it should be understood that these terms mean "one or more" unless context unambiguously requires a more restricted meaning. The term "or" should be understood to encompass items in the alternative or together, unless context unambiguously requires otherwise. If aspects of the invention are described as "comprising" a feature, embodiments also are contemplated "consisting of" or "consisting essentially of" the feature. Where the term "about" is used the application also discloses employing the exact value specified.

Antibodies against sclerostin may be used to treat bone disorders, as they both promote bone formation and inhibit bone resorption. After multiple doses of anti-sclerostin antibody are administered, resistance to the antibody may though develop, where the response to the antibody is diminished and is lower than the "naïve" response seen when the anti-sclerostin antibody is administered for the first time to a subject. Such resistance may reduce the efficacy of treatment, particularly for subjects who have chronic conditions that require long term treatment.

Unexpectedly, it has now been shown that the development of such resistance is reversible. In particular, by allowing patients a dosing holiday, where they are not administered the anti-sclerostin antibody, the subject may once again show a higher response to a subsequent dose of the anti-sclerostin antibody. In some cases, multiple cycles of a batch of at least two doses of the anti-sclerostin antibody, followed by a dosing holiday, are performed, so that the subject may be given anti-sclerostin antibody treatment over a prolonged period, whilst minimizing the development of resistance to the antibody.

The method may be, in some instances, combined with monitoring for resistance to the antibody, such as by monitoring the response seen, to help optimize when best to give the patient the dosing holiday. Further, in some instances, the patient may be treated with a different therapy for the bone disorder in the dosing holiday for the anti-sclerostin antibody. In particular, the subject may be administered bisphosphonates during the dosing holiday. That has the further advantage that it means the subject is not treated continuously with the other therapy. For instance, it may be beneficial for subjects to have a break from treatment with another therapeutic, such as bisphosphonates, and cycling between antibody and bisphosphonate treatment also helps avoid continuous treatment with bisphosphonates. In some instances, the different therapy may be an anti-resorptive which is not a bisphosphonate, including any of those discussed herein.

Hence, the present invention provides a method for treating a bone disorder associated with at least one of low bone formation, low bone mineral density, low bone mineral content, low bone mass, low bone quality and low bone strength in a mammalian subject, which method comprises:
  (a) administering a batch of at least two doses of anti-sclerostin antibody to a subject in need of such treatment;
  (b) then allowing the subject a dosing holiday, which is greater in length than the time interval been two successive doses in the batch of (a); and
  (c) administering to the subject at least one further dose of anti-sclerostin antibody after the dosing holiday of (b).

The invention further provides a method for treating a bone disorder associated with at least one of low bone formation, low bone mineral density, low bone mineral content, low bone mass, low bone quality and low bone strength in a mammalian subject, which method comprises:
  (a) administering at least one dose of anti-sclerostin antibody to the subject and monitoring the subject to identify whether the subject shows a reduced response to a dose of the anti-sclerostin antibody; and
  (b) if such a reduced response is identified, allowing the subject a dosing holiday which is at least four weeks in length.

The invention also provides a method for treating a bone disorder associated with at least one of low bone formation, low bone mineral density, low bone mineral content, low bone mass, low bone quality and low bone strength in a mammalian subject, which method comprises:
  (a) administering a batch of at least two doses of anti-sclerostin antibodies to a subject in need of such treatment and monitoring the subject to identify when the subject shows a reduced response to a dose of the anti-sclerostin antibody;
  (b) when such a reduced response is identified, allowing the subject a dosing holiday which is greater in length than the time interval been two successive doses in the batch of (a); and
  (c) administering to the subject at least one further dose of anti-sclerostin antibody after the dosing holiday of (b).

The invention also provides a method for treating a bone disorder associated with at least one of low bone formation, low bone mineral density, low bone mineral content, low bone mass, low bone quality and low bone strength in a mammalian subject, which method comprises:
  (a) administering to a subject in need of such treatment a batch of at least two doses of anti-sclerostin antibody;
  (b) then allowing the subject a dosing holiday which is greater in length than the interval been two successive doses in the batch of (a), where during that interval the subject is administered a different treatment for the bone disorder; and
  (c) after the dosing holiday of (b) administering to the subject at least one further dose of anti-sclerostin antibody.

The invention further provides an anti-sclerostin antibody for use in a method of treating a bone disorder associated with at least one of low bone formation, low bone mineral density, low bone mineral content, low bone mass, low bone quality and low bone strength in a mammalian subject, which method comprises:
  (a) administering a batch of at least two doses of anti-sclerostin antibody to a subject in need of such treatment;
  (b) then allowing the subject a dosing holiday, which is greater in length than the time interval been two successive doses in the batch of (a); and
  (c) administering to the subject at least one further dose of anti-sclerostin antibody after the dosing holiday of (b).

Also provided by the invention is an anti-sclerostin antibody for use in a method for treating a bone disorder associated with at least one of low bone formation, low bone mineral density, low bone mineral content, low bone mass, low bone quality and low bone strength in a mammalian subject, which method comprises:
  (a) administering at least one dose of anti-sclerostin antibody to a subject in need of such treatment and monitoring the subject to identify whether the subject shows a reduced response to a dose of the anti-sclerostin antibody; and
  (b) if such a reduced response is identified, allowing the subject a dosing holiday which is at least four weeks in length.

Further provided by the invention is an anti-sclerostin antibody for use in a method of treating a bone disorder associated with at least one of low bone formation, low bone mineral density, low bone mineral content, low bone mass, low bone quality and low bone strength in a mammalian subject, which method comprises:
  (a) administering a batch of at least two doses of anti-sclerostin antibody to a subject in need of such treatment and monitoring the subject to identify when the subject shows a reduced response to a dose of the anti-sclerostin antibody;
  (b) when such a reduced response is identified, allowing the subject a dosing holiday which is greater in length than the time interval been two successive doses in the batch of (a); and
  (c) administering to the subject at least one further dose of anti-sclerostin antibody after the dosing holiday of (b).

The invention also provides for the use of an anti-sclerostin antibody in the manufacture of a medicament for use in treating a bone disorder associated with at least one of low bone formation, low bone mineral density, low bone mineral content, low bone mass, low bone quality and low bone strength in a mammalian subject, where the medicament is to be administered in a method comprising:
  (a) administering a batch of at least two doses of anti-sclerostin antibody to a subject in need of such treatment;
  (b) then allowing the subject a dosing holiday, which is greater in length than the time interval been two successive doses in the batch of (a); and
  (c) administering to the subject at least one further dose of anti-sclerostin antibody after the dosing holiday of (b).

Additionally, the invention provides for the use of an anti-sclerostin antibody in the manufacture of a medicament for use in treating a bone disorder associated with at least one of low bone formation, low bone mineral density, low bone mineral content, low bone mass, low bone quality and low bone strength in a mammalian subject, where the medicament is to be administered in a method comprising:

(a) administering at least one dose of anti-sclerostin antibody to a subject in need of such treatment and monitoring the subject to identify whether the subject shows a reduced response to a dose of the anti-sclerostin antibody; and (b) if such a reduced response is identified, allowing the subject a dosing holiday which is at least four weeks in length.

The invention further provides for the use of an anti-sclerostin antibody in the manufacture of a medicament for use in treating a bone disorder associated with at least one of low bone formation, low bone mineral density, low bone mineral content, low bone mass, low bone quality and low bone strength in a mammalian subject, where the medicament is to be administered in a method comprising:

(a) administering a batch of at least two doses of anti-sclerostin antibody to a subject in need of such treatment and monitoring the subject to identify when the subject shows a reduced response to a dose of the anti-sclerostin antibody;

(b) when such a reduced response is identified, allowing the subject a dosing holiday which is greater in length than the time interval been two successive doses in the batch of (a); and (c) administering to the subject at least one further dose of anti-sclerostin antibody after the dosing holiday of (b).

The invention also provides for the use of an anti-sclerostin antibody in the manufacture of a medicament for use in treating a bone disorder associated with at least one of low bone formation, low bone mineral density, low bone mineral content, low bone mass, low bone quality and low bone strength in a mammalian subject, where the medicament is to be administered in a method comprising:

(a) administering to a subject in need of such treatment a batch of at least two doses of anti-sclerostin antibody;

(b) then allowing the subject a dosing holiday which is greater in length than the interval been two successive doses in the batch of (a), where during that interval the subject is administered a different treatment for the bone disorder; and (c) after the dosing holiday of (b) administering to the subject at least one further dose of anti-sclerostin antibody.

BRIEF DESCRIPTION OF THE FIGURES

FIG. 7 is a chart listing amino acid sequences and sequence identifiers for amino acid sequences of various anti-sclerostin antibodies described herein. The sequence identifiers refer to amino acid sequences provided in the Sequence Listing submitted herewith. The amino acid sequences also are set forth in U.S. Patent Publication No. 20070110747, hereby incorporated by reference.

FIG. 8 is a listing of amino acid sequences and nucleotide sequences set forth in International Patent Publication No. WO 2008/115732, referred to herein.

FIG. 9 is a listing of amino acid sequences and nucleotide sequences set forth in International Patent Publication No. WO 2009/047356, referred to herein.

FIG. 10 is a listing of amino acid sequences and nucleotide sequences set forth in International Patent Publication No. WO 2010/130830, referred to herein.

DETAILED DESCRIPTION OF THE INVENTION

Figure 1:
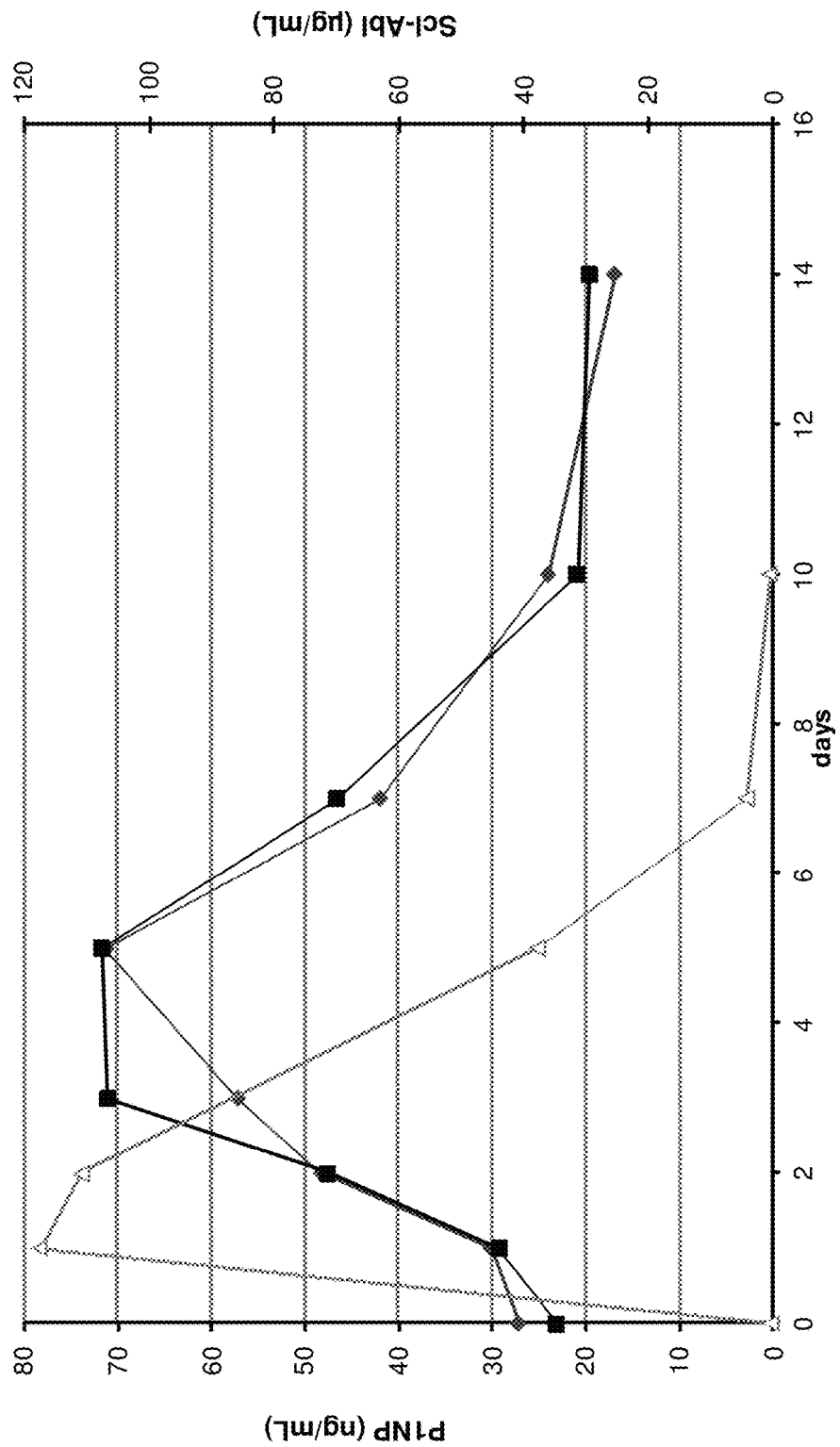
FIG. 1 shows the results of a preliminary experiment to measure the kinetics of P1NP response after subcutaneous administration of anti-sclerostin antibody to help gauge when best to measure P1NP levels in the subsequent experiments. Circulating P1NP levels for two mice dosed subcutaneously with 10 mg/kg on day 0 are shown (square and diamond symbols) along with the level of anti-sclerostin antibody in a similarly dosed mouse (triangular symbols).

Unexpectedly, it has been shown that it is possible to reverse, or reduce, the resistance which develops when multiple doses of anti-sclerostin antibody are administered by allowing the subject a dosing holiday where they are not administered the antibody. After the dosing holiday, the subject typically shows an increased response to the anti-sclerostin antibody in comparison to a response prior to the dosing holiday.

Dosing

Prior to being given a dosing holiday, the subject will have been administered at least one dose of anti-sclerostin antibody. Typically, the subject will have been given a plurality of doses prior to the holiday. For instance, the subject may have been given a batch of at least two doses of the anti-sclerostin antibody prior to the dosing holiday. Preferably, the subject may have been administered three, four, five, or at least those numbers of doses of antibody before being given a dosing holiday. The administration of such a batch of doses may form part of the invention.

In some cases, the subject may be given a batch of two, three, four, five, six, seven, eight, nine or more doses prior to the dosing holiday, or at least that number of doses. In some instances, the subject may have been given a batch of ten, eleven, twelve, thirteen, fourteen, fifteen, sixteen or more doses of the antibody. In some instances the subject may have been given a batch of ten or less, nine or less, eight or less, seven or less, six or less or five or less doses, where the number of doses given is at least two, preferably at least three and more preferably at least four doses. It may be that the subject is given a batch of from two to sixteen doses, such as from two to fourteen doses or from two to twelve doses. In some instances, the subject may have been given a batch of from two to seven, from two to six, from two to five, or from two to four doses prior to the holiday. In other instances, the number of doses may be from three to eight, seven, six, five or four doses. In other instances, the number of doses in the batch may be from four to eight, seven, six, or five doses. In some instances, the subject may have been given twelve doses of the antibody. In one instance, the subject will have been administered, or is administered, a batch of doses, where the overall time period for the batch is at least two, three, four, five, six, seven, eight, nine, ten, eleven or twelve months or, for example, at least about 4, 8, 12, 16, 20 or 24 weeks in length. In one instance, the overall duration of a batch of doses may be about six months, twelve months (i.e., one year) or eighteen months.

In some instances, the interval between individual doses in a batch may be about two weeks. In other cases, the interval may be longer. For instance, the interval may be about a month, 2 months, 3 months, 4 months, 5 months, 6 months or longer. In some cases, the interval between doses in a batch may be about every two, three, four, five, six, seven, or eight weeks. In some cases, the interval between doses in a batch may be about from one week to six months, from two weeks to four months, from three weeks to six weeks, or from four to five weeks. In one preferred instance, the interval between doses may be about a month or may be about four weeks. In other instances, the interval may be about 7 days, a week, 2 weeks, 3 weeks, four weeks, 1 month, 5 weeks, 6 weeks, 7 weeks, 2 months, 8 weeks, 9 weeks, 10 weeks, 11 weeks, 12 weeks or 3 months. In some instances, the interval between doses in a batch may be about a day, two days, three days, four days, five days, six days, seven days or longer. In some instances, the doses may be given once, twice, three, four, five, six or seven times a week.

In some instances, the doses in a batch may be administered every week, two weeks, four weeks, six weeks or eight weeks, or about such intervals. The intervals between doses in a batch may be, for instance, monthly, two monthly or three monthly, or about those intervals. In some cases individual doses of antibody may be given more than once a week, such as two, three or four times a week. For instance, doses may be administered in some cases every two, three, four, five, six, seven or eight days to the subject.

In some instances, the invention may entail administering any of the above specified batches of dosages, for instance as part of the method of the invention. In some instances, the subject may have been known to have been administered such a number of doses, but the administration of the batch of the doses does not form part of the method, rather the subject is simply given a dosing holiday prior to being administered a further batch of doses.

In some cases the number of doses given to the subject is such that a drop of the response of the subject to the antibody is seen for at least one of the doses given in a batch, for instance for the last dose prior to the holiday being initiated. The dosing holiday may begin when the subject first shows a reduction in the response to the antibody. In some instances, the dosing holiday may begin after one, two or three doses showing a reduced effect. For instance, in some cases the dosing holiday may be started where a subsequent dose shows a reduced effect in comparison to the response seen with the first dose of the antibody given to the subject. In some cases, it may be that the average response seen for at least two doses is reduced in comparison to that seen for two earlier doses, particularly the first two doses.

In some instances, the subject may be actively monitored to determine the best time for the dosing holiday, in other cases the subject is not monitored for resistance. In some cases, the dosing holiday may be initiated when the response seen for a dose of antibody falls below 90%, 80%, 70%, 60%, 50%, 40%, 30% or less than the response seen with an earlier dose, such as for the first dose. In some instances, the dosing holiday may be initiated when the response to a dose is below such a percentage in comparison to what would be expected for a naive subject with the same disorder, such as an age and gender matched subject. In some instances, the drop in response may be at least 5%, 15%, 20%, 25%, 30%, 40%, 50% or more. In some course the parameter used to gauge how much the response is reduced is any of those mentioned herein. In one preferred instance, the response may be that defined by reference to P1NP levels, though any of the markers discussed herein may be employed.

In some instances, the response may be that gauged using change in bone mineral density (BMD). The rate, or amount, of bone formation, the rate, or amount, of bone resorption, or any combination thereof may also be used as a parameter to define the response to the antibody. It may be that the anti-sclerostin antibody still brings about an increase in BMD, but the increase is less than that for a naïve subject. Hence, a reduced response may be one with a smaller increase than would be expected for a naïve subject, including for any of the markers discussed herein.

Dosing Holidays

Typically a dosing holiday is a time period where no anti-sclerostin antibody is administered to a subject. Such a dosing holiday may help reduce, reverse or prevent the reduced response to an anti-sclerostin antibody seen in subjects given a plurality of doses of the antibody and hence help improve the efficiency of treatment of bone disorders with anti-sclerostin antibodies. Typically, the dosing holiday will result in reversal or reduction of the reduced response displayed by the subject to the anti-sclerostin antibody. Hence, the subject may display a higher response to the antibody than prior to the dosing holiday. The subject may, for instance, display a response to the anti-sclerostin antibody which is closer to the "naïve" response to the antibody when the subject was first administered the anti-sclerostin antibody. For at least about 50%, 60%, 70%, 80%, 90%, 95%, or 99% of the naïve response or even about 100% of the naïve response. In a preferred instance, the dosing holiday will result in a higher response to the anti-sclerostin antibody as measured by a bone marker, such as a marker of bone resorption and/or formation, including any of those mentioned herein, particularly P1NP.

Typically, the administration of a batch of doses, followed by a dosing holiday and then administration of at least one dose of antibody, means that the dosing regimen followed is one of irregular dosing. Hence, the treatment may be characterized by irregular dosing, such as over the treatment period as a whole. The length of a dosing holiday may vary. A dosing holiday will be typically longer in length than the interval between individual doses in a batch, for instance the interval between doses in a batch of doses known to have been administered to the subject or administered to the subject as part of the invention. In some instances, the dosing holiday may be any of the above specified lengths as long as the interval between doses in the preceding batch is shorter. In some instances, the dosing holiday may be any of at least 4, 5, 6, 7, 8, 19, 10, 11 or 12 weeks or about such duration. It may be the dosing holiday is at least 14, 16, 18, 20, 22, 24, 26, 28, 30, 35, 40, 45 or 50 weeks in length or may be of about such duration. In some instances, the dosing holiday may be from about four weeks to 52 weeks, for example from six weeks to 24 weeks, in some cases from eight weeks to 12 weeks. In some instances of the invention, the dosing holiday may be about two months, three months, four months, five months, six months, seven months, eight months, nine months, ten months, eleven months or twelve months or at least those time periods. In some cases the dosing holiday may be about, or at least, eighteen months in length. For instance, the dosing holiday may be about four weeks, six weeks, eight weeks, ten weeks, or twelve weeks longer than the interval between doses in a batch of doses. In some instances, the dosing holiday may be equivalent to the total duration of a batch of doses, such as any of those specified herein, or in other instances it may be equivalent to the overall duration of a batch of doses, plus an additional two, four, six, eight, twelve or more weeks in length.

It may be that the dosing holiday is at least two, three, four, five, six, seven, eight, nine or ten weeks longer than the interval between two doses in the preceding batch, or the dosing interval may be of such length. In some cases the dosing holiday may be such a length longer than the average interval for three, four, five, six, seven or more doses in a batch or, for example, than the average interval between all of the doses in a batch. The total length of the dosing holiday may be, for example, four, five, six, seven, eight, nine, ten or more weeks. For instance, the dosing holiday may be one, two, three, four, five or six months in length and in some cases may be at least a year, or eighteen months in length. In some cases, the dosing holiday may be from a month to a year, such as from two to six months in length. In some cases, the dosing holiday may be from four to sixteen weeks, for instance, from six to twelve weeks, for example from eight to ten weeks in length. In other instances, the dosing holiday may be about from six to eighteen months, for instance about a year. In some cases the dosing holiday may be about twice, three times, four times, five times, six times, seven times, eight times, nine times or more in duration than the interval between doses in a batch administered to the subject. In some instances, where a different treatment is administered during the dosing holiday, the duration of the dosing holiday may be the normal duration for a course of a different treatment for the disorder to be administered in the dosing holiday.

In some cases, the subject is given more than one dosing holiday. In particular, after the first dosing holiday, the subject is given at least two doses of the antibody and may, for instance, benefit from a further dosing holiday. In some cases, it may be that the subject is given two, three, four, five, six, seven, or more dosing holidays in the course of their treatment. The administration of at least two doses of the antibody, followed by a dosing holiday, may be referred to as a cycle and in some instances, one, two, three, four, five, six, seven, eight, nine, ten or more such cycles may be used. In other instances, the overall total treatment period may be at least six months, nine months, a year, eighteen months, twenty-four months, or more. It may be that the overall treatment is at least 4, 8, 12, 16, 20, 24, 28, 32, 36, 40, 44, 48 or 52 weeks, or longer, or about such periods. In some instances, where the subject is being treated indefinitely with the antibody, it may be that the approach of batches of doses combined with dosing holidays is continued as long as the treatment lasts. In some instances, it may simply be that a set regimen of batch doses alternating with dosing holidays is administered. For instance, any combination of those batches and dosing holidays specified herein, for example for two, three, four, five, six or more cycles of a batch of doses followed by a dosing holiday may be administered.

In some instances, any of the batches of doses specified herein may be combined with any of the dosing holidays specified herein, as long as the dosing holiday is longer than the interval between doses in a batch. For instance, a batch of doses administered at daily, weekly, fortnightly, four weekly, six weekly or eight weekly intervals may be combined with a dosing holiday of at least six weeks, at least eight weeks, at least twelve weeks, at least 16 weeks, at least 20 weeks or at least 24 weeks, where the dosing holiday is longer than the interval between batches. In some instances, the doses in the batch may be given at about monthly or two monthly intervals and may be combined with a dosing holiday of at least three, four, five, six, eight, ten, twelve or more months in length. In some cases, the batch of doses may comprise three to fourteen doses at daily, weekly, fortnightly, four weekly or six weekly intervals, combined with a dosing holiday of at least six, eight, ten, twelve, fourteen or more weeks in length, where the dosing holiday is longer than the interval between the doses in the batch. In one instance, a batch of monthly doses is combined with a dosing holiday of at least two, three, four, five, six, twelve or more months in length. In some instances, it may be that the doses in the batch are given about every four weeks.

In some cases, the interval between earlier doses will not be known and the subject will simply be one who is displaying a reduced response to the anti-sclerostin antibody in comparison to what would be expected for the subject. Hence, it may be that the length of the dosing holiday given is simply one of the above time periods without reference to the time between administration of earlier doses or the response to earlier doses. For example, the dosing holiday may be six weeks, eight weeks, twelve weeks, sixteen weeks, twenty weeks, twenty four weeks or more in length or any of the other possible lengths referred to. In some cases the subject may have been identified as one showing resistance to anti-sclerostin antibody, for example, even though the precise regimen previously administered is not known. It may be that they have been administered the antibody for at least about two, three, four, five, six or more months in length and hence be identified as a candidate for a dosing holiday. In some cases they may have been administered the antibody for at least about nine, twelve or eighteen months in length and hence be identified as a candidate for a dosing holiday. The subject may be displaying reduced or diminishing therapy from the existing therapy.

A fixed regimen of batch dosing and dosing holiday may be applied in some instances including any of those specified herein. It may be the fix regimen is designed with reference to age, gender, weight, the nature of the disorder, the severity of the disorder and so on.

Responses and Monitoring

In one instance, the response is the response as defined by a bone marker, for instance a bone formation and/or bone resorption marker, particularly any of those referred to herein. For instance, whether or not a response can be considered reduced may be, in some instances, defined by whether the response of the bone marker to administration of the anti-sclerostin antibody is reduced. Similarly, whether a dosing holiday may be said to prevent, or reverse, resistance to an anti-sclerostin antibody may be defined by the response of a bone marker and, for instance, the level of that marker. In a preferred instance, the response to the antibody is defined by P1NP level, particularly serum P1NP level.

In one instance, the response of the subject to a dose of anti-sclerostin antibody is measured to help gauge whether the subject is displaying resistance to the anti-sclerostin antibody. Any suitable means of measuring the response to the anti-sclerostin antibody may be employed. For instance, the level of a bone marker may be measured, in particular a marker of bone formation and/or mineralization may be measured in the subject. Markers of bone resorption may also be employed. In other instances, the invention itself does not entail measurement, or monitoring, of the response, but the response in question is that defined by a bone marker, such as, the level of any of the bone markers referred to herein.

Markers indicative of bone resorption (or osteoclast activity) which may be used include, for example, C-telopeptide (e.g., C-terminal telopeptide of type 1 collagen (CTX) or serum cross-linked C-telopeptide), N-telopeptide (N-terminal telopeptide of type 1 collagen (NTX)), deoxypyridinoline (DPD), pyridinoline, urinary hydroxyproline, galactosyl hydroxylysine, and tartrate-resistant acid phosphatase (e.g., serum tartrate-resistant acid phosphatase isoform 5b). Bone formation/mineralization markers which may be used include, but are not limited to, bone-specific alkaline phosphatase (BSAP), peptides released from N- and C-terminal extension of type I procollagen (P1NP, PICP), and osteocalcin (OstCa). Several kits are commercially-available to detect and quantify markers in clinical samples, such as urine and blood. In one preferred instance, the marker used is selected from the serum level of C-telopeptide of type I collagen (CTX), bone-specific alkaline phosphatase (BSAP), osteocalcin (OstCa), and/or N-terminal extension of procollagen type 1 (P1NP). In a preferred instance, the response is the response to such a marker.

Other approaches for measuring the effect of the anti-sclerostin antibody include assessing bone mineral content and/or bone density. In some instances, the response in question may be defined by reference to bone mineral density (BMD) or bone mineral content (BMC). In some cases, it may be that the reduced response is a reduced rate of increase of BMD and/or BMC following administration of the antibody. In other words, administration of the antibody still results in an increase in bone formation and/or a reduction of bone absorption, for example in terms of BMD/BMC, but at a reduced rate compared to a naïve subject. The use of a dosing holiday may mean the subject again displays the same size of increase in such parameters as a naïve subject, or at least closer to a naïve subject.

Bone mineral density may be, for instance, measured using techniques, such as, single- and dual-energy X-ray absorptometry, ultrasound, computed tomography, radiography, and magnetic resonance imaging. The amount of bone mass may also be calculated from body weights or by using other methods (see Guinness-Hey, *Metab. Bone Dis. Relat. Res.,* 5:177-181 (1984)). In humans, bone mineral density may be, for instance, determined clinically using dual x-ray absorptiometry (DXA) of, for example, the hip and spine. Other techniques include quantitative computed tomography (QCT), ultrasonography, single-energy x-ray absorptiometry (SXA), and radiographic absorptiometry. Common central skeletal sites for measurement include the spine and hip; peripheral sites include the forearm, finger, wrist and heel. Except for ultrasonography, the American Medical Association notes that BMD techniques typically involve the use of x-rays and are based on the principle that attenuation of the radiation depends on thickness and composition of the tissues in the radiation path. All techniques may employ the comparison of results to a normative database or control subject.

In some instances, the bone mineral density (BMD) of the subject is compared to the peak density of a 30-year old healthy adult (i.e., a "young adult"), creating the so-called "T-score." A patient's BMD also may be compared to an "age-matched" bone density (see, e.g., World Health Organization Scientific Group on the Prevention and Management of Osteoporosis, "Prevention and management of osteoporosis: report of a WHO scientific group." WHO Technical Report Series; 921, Geneva, Switzerland (2000)). The difference between a patient's BMD and that of a healthy, young adult is conventionally referred to in terms of the multiple of a "standard deviation," which typically equals about 10% to about 12% decrease in bone density. The World Health Organization proposed four diagnostic categories based on BMD T-scores. A BMD value within 1 standard deviation of the young adult reference mean (T-score>−1) is "normal." Low bone mass (osteopenia) is indicated by a BMD value more than 1 standard deviation below the young adult mean, but less than 2.5 standard deviations (T-score<−1 and >−2.5). A T-score of more than 2.5 standard deviations below the norm supports a diagnosis of osteoporosis. If a patient additionally suffers from one or more fragility fractures, the patient qualifies as having severe osteoporosis. Hence, the invention may entail calculating the T-score for the subject, for instance, in response to a dose of anti-sclerostin antibody and determining whether there is a reduced improvement in the T-score following administration of a dose of the anti-sclerostin antibody.

In some instances, the decision as to when to initiate the dosing holiday may therefore be based on assessing the response of the subject to a dose of the anti-sclerostin antibody and determining whether the response is lower than expected. The dosing holiday may be, for instance, initiated when monitoring shows a reduced response to a dose, or two consecutive doses, particularly in comparison to earlier doses, such as the first dose, or in comparison to the average response seen for the doses in the batch. The dosing holiday may be, for instance, begun, when the positive results seen with the treatment plateau or begin to tail-off for the batch of doses administered. It may be that the dosing holiday is administered when administration of the antibody results in a smaller increase of the particular parameter or marker than would be expected. For instance, when the response is less than 90%, 80%, 70%, 60%, 50%, 40%, 30%, 25% or less than that which would be expected from the equivalent naïve subject or displayed to an earlier dose by the same subject.

In some instances of the invention the subject may be administered a test dose of anti-sclerostin to gauge their response to the antibody. In particular, where the subject is known to have been administered at least two, three, four, five, or six doses of anti-sclerostin antibody previously or indeed any of the types of batch of doses specified herein. The test dose may be given, the response measured, and, if considered reduced, the subject will be given a dosing holiday. If the subject does not display a reduced response, they may be given further doses of anti-sclerostin antibody. In some cases, rather than a single test dose, the subject is administered at least two, three, four, five, or six doses and their response measured.

It may be, for instance, that a subject is monitored continuously, for example after each dose of anti-sclerostin antibody. It may be that the subject is monitored, for instance, about once a month, once about every two months, once about every three months, once about every four months, once about every six months or about once a year. It may be that the subject is monitored immediately before a dose is administered and then, for example, about one, two, three, four, five or six weeks later. It may be, for example, that the response seen for at least one, two, three, four, five or more doses is monitored. In some cases, the dosing holiday may be initiated when the monitoring shows the response is below an expected level for the subject or below a set cut-off value.

For instance, the dosing holiday may be initiated when the response for a dose is less than the response seen for an earlier dose, such as that for the first dose, or for the first dose in a batch of doses. The size of the response as a percentage of the response to an earlier dose may be determined, particularly the first dose, and it may be that when the percentage value falls to, or below, one of the percentage values specified herein the dosing holiday is begun.

In some cases, the response to a dose may be measured without any reference to earlier doses and simply the fact it falls below an expected value means a dosing holiday is initiated. Hence, in one instance, the method of the invention may comprise: (a) administering a dose of anti-sclerostin antibody to a subject who has previously been administered anti-sclerostin antibody; (b) measuring the response to the dose; and (c) assessing whether the dose is lower than that expected. If the response is lower than that expected, for instance below a threshold, then a dosing holiday may be given. If the response to the test dose is not though reduced, then the method may optionally comprise administering at least one further dose of the anti-sclerostin antibody to the subject and measuring until a reduced response is seen, then giving a dosing holiday. In some instances, it may be that the subject has already been administered at least three, four, five or six doses before the test dose.

A dosing holiday may include the administration of one or more test doses of anti-sclerostin antibody, where the test dose is used to determine if the resistance displayed to the antibody has diminished or been eliminated. In particular, where the test dose is used to determine whether to terminate the dosing holiday and again begin treatment with the anti-sclerostin antibody or continue the dosing holiday. Hence, in some cases, it may be that the subject may be given a dosing holiday and the end of the dosing holiday may be defined by when the subject displays an increased response to a test dose of anti-sclerostin antibody or, for instance, the subject displays resistance below a defined threshold, such as any of those mentioned herein.

In one case, the subject may be given a set pattern of a batch of at least two doses, followed by a set dosing holiday, without monitoring to determine when to initiate the dosing holiday. Such fixed batches of doses and dosing holidays may be, for example, based on the disorder to be treated, age, gender and weight of the subject. In other instances, it may be that a suitable cycle of a batch of doses and dosing holiday is determined on a particular cycle by monitoring and then adhered to on subsequent cycles to the same regimen.

In a preferred instance, where a test dose is given, what will be monitored, or how the response is defined, will be reference to a bone formation and/or resorption marker, including any of those referred to herein, particularly P1NP levels. It may be that the level of the marker is measured before administration of the dose, then, for instance, four, five, six, seven, eight, ten, eleven or twelve days after administration of the test dose.

In some cases, rather than determining the response to an individual dose, it may be that any of the parameters referred to herein are measured during a course of treatment to determine if they are less than expected or show a slower, or less marked, increase in the marker. It may be that the subject is assessed clinically to determine whether the effect of the treatment is less and so that a dosing holiday may be of benefit. It may be that the subject has regular checks, such as about monthly, three monthly, four monthly, six monthly or yearly intervals and such checks entail checking or measuring the effect of the anti-sclerostin antibody and/or dosing holiday, for instance to decide whether to commence a dosing holiday.

In some cases the invention may be administered to a patient group thought to be displaying resistance to anti-sclerostin antibodies, or thought likely to display such resistance to the antibody. In some cases, the invention may be applied to a patient group displaying a higher than average resistance to anti-sclerostin antibodies. It may be that such a patient population is identified using monitoring, such any of the monitoring means discussed herein, particularly any of the markers discussed herein. Identification of such patients may entail administration of a test dose as described herein, followed by measurement of the response and assessment of whether the response seen is less than expected. It may be though that the patients are identified due to the fact that they have been receiving anti-sclerostin antibodies and the improvement initially seen has diminished. It may be that whilst the subject still shows an improvement in bone mineral density, that the improvement is less than first seen or would be expected for a naïve subject. Hence, whilst administration of anti-sclerostin antibody may still promote bone formation and/or inhibit resorption, the effect may be less pronounced. In one instance, the invention may be applied to a subject who has been administered anti-sclerostin antibodies, but the treatment has been discontinued, particularly where the treatment has been discontinued because the subject is displaying a reduced response to the anti-sclerostin antibodies.

Any of the methods of the invention, and other aspects, may comprise first assessing whether a subject is one displaying resistance to anti-sclerostin antibodies and then applying the invention if the subject does display such resistance. Hence, if such resistance is displayed, the invention may then entail allowing the subject a dosing holiday to reverse or reduce that resistance.

Some markers may display diurnal variation, i.e., display variation in their level during the day. Hence, a marker may be measured at a specific time, or time period, in the day. In some instances, where a particular marker is measured more than once, it may be that the marker is measured each time at, or approximately at, the same time in the day, or in about a one hour, two hour, or three hour window. For instance, the marker may be consistently measured in the morning or consistently in the afternoon. In one case, any of the markers measured herein may be measured in such a manner, particularly including those known to show diurnal variation. In some instances, P1NP levels may be measured in such a manner. In some cases, where a marker is measured and compared to a standard, or expected value, the value is measured at a time in the day, or time period, consistent with the standard or expected value.

Doses

The amount of anti-sclerostin antibody administered as an individual dose to the subject may, for instance, comprise at least about 70 mg of the anti-sclerostin antibody. For example, in various aspects, the amount of anti-sclerostin antibody administered is at least about 120 mg (e.g., 180 mg) or at least about 140 mg, e.g., at least about 210 mg anti-sclerostin antibody. The amount of anti-sclerostin antibody administered may be, for instance, no more than about 350 mg anti-sclerostin antibody, e.g., no more than about 280 mg anti-sclerostin antibody (e.g., 270 mg), no more than about 210 mg of anti-sclerostin antibody, no more than about 140 mg anti-sclerostin antibody, or no more than about 120 mg anti-sclerostin antibody (e.g., about 120 mg of antibody). Put another way, a single administration or dose of anti-sclerostin comprises, for example, no more than about 350 mg of the antibody.

In some instances, the subject is administered a dose of anti-sclerostin antibody in an amount of about 70 mg to about 350 mg, such as about 70 mg to about 280 mg, or about 120 mg to about 350 mg, or about 140 mg to about 350 mg, or about 210 mg to about 350 mg, or about 280 mg to about 350 mg. Optionally, a single dose of anti-sclerostin antibody comprises about 70 mg to about 210 mg of anti-sclerostin antibody, such as about 70 mg to about 120 mg (e.g., about 70 mg) anti-sclerostin antibody, or about 70 mg to about 140 mg of anti-sclerostin antibody, or about 120 mg to about 210 mg anti-sclerostin antibody, or about 120 mg to about 140 mg of anti-sclerostin antibody. Optionally, a single dose of anti-sclerostin antibody comprises about 140 mg to about 210 mg (e.g., about 140 mg or about 210 mg) of anti-sclerostin antibody.

In some instances, the dose administered is between about 0.1 to about 20 mg/kg, or about 0.1 to about 12 mg/kg, or about 0.5 to about 12 mg/kg, or about 1 to about 10 mg/kg, or about 1 to about 8 mg/kg, or about 2 to about 8 mg/kg, or about 3 to about 8 mg/kg. In some instances, a dose is about 1 mg/kg to about 10 mg/kg (e.g., about 2 mg/kg or about 9 mg/kg), about 1 mg/kg to about 3 mg/kg, or about 3 mg/kg to about 8 mg/kg (e.g., about 4 mg/kg, 5 mg/kg, 6 mg/kg, or 7 mg/kg). In the case of individuals with significantly lower or higher weight than average, it may some times be that the dose is calculated based on a per weight basis specifically for that subject.

In some instances, particularly where the interval between doses is short, it may be that a low dose is employed. For instance, a lower dose may be employed where an interval between doses of less than two weeks, such as less than one week, in particular any of the time periods specified herein shorter than a week, is employed. For example, in some cases, the dose may be any of the above specified doses of 2 mg/kg or under. In some cases, the dose may be about, or under, 1 mg/kg, 0.75 mg/kg, 0.5 mg/kg, 0.25 mg/kg or 0.1 mg/kg. In some instances, a fixed dose is administered, such as any of about 1 to about 50 mg, about 1 to about 25 mg, about 1 to about 10 mg, about 1 to about 5 mg or about 1 to about 3 mg. For example, a fixed dose of from about 2 to about 5 mg, about 2 to about 7 mg or about 3 to about 8 mg may be employed.

Reference herein to a single dose may include multiple contemporaneous injections be administered to achieve delivery of the dose. For instance, several injections within the space of an hour, day or week.

Typically, the subject will be administered a plurality of doses of anti-sclerostin antibody and in particular a batch of doses. In some instances, all of the doses within a batch will be approximately the same amount, or actually the same amount. In some instances, the doses administered in the different batches will be the same. In others, the dose may vary between different batches. For instance, it may be that the dose is varied according to how the patient is responding to the treatment.

Anti-Sclerostin Antibodies

Any suitable anti-sclerostin antibody may be employed in the present invention. The term "antibody" refers to an intact antibody, or a binding fragment thereof. An antibody may comprise a complete antibody (immunoglobulin) molecule (including polyclonal, monoclonal, chimeric, humanized, and/or human versions having full length heavy and/or light chains), or comprise an antigen binding fragment thereof. Antibody fragments include $F(ab')_2$, Fab, Fab', Fv, Fc, and Fd fragments, and can be incorporated into single domain antibodies (e.g., nanobodies), single-chain antibodies, maxibodies, minibodies, intrabodies, diabodies, triabodies, tetrabodies, v-NAR and bis-scFv (see, e.g., Hollinger and Hudson, *Nature Biotechnology*, 23(9):1126-1136 (2005)). Antibody polypeptides, including fibronectin polypeptide monobodies, also are disclosed in U.S. Pat. No. 6,703,199. Other antibody polypeptides are disclosed in U.S. Patent Publication No. 20050238646. U.S. Pat. Nos. 6,395,511 and 6,803,453, and U.S. Patent Publication Nos. 20040009535 and 20050106683 (incorporated in their entirety by reference for their disclosure of anti-sclerostin antibodies) refer to anti-sclerostin antibodies generally. The amino acid sequence of human sclerostin is set forth in SEQ ID NO: 1 of the Sequence Listing and is provided as SEQ ID NO: 1 of U.S. Patent Publication No. 20070110747 (which patent publication is incorporated in its entirety for its description of sclerostin and sclerostin binding agents and Sequence Listing). Sclerostin also is described in Brunkow et al., *Am. J. Hum. Genet.*, 68:577-589 (2001); and Balemans et al., *Hum. Mol. Genet.*, 10:537-543 (2001). Additional information regarding materials and methods for generating anti-sclerostin antibodies can be found in U.S. Patent Publication No. 20040158045 (hereby incorporated by reference in its entirety).

An antibody fragment may be any synthetic or genetically engineered protein. For example, antibody fragments include isolated fragments consisting of the light chain variable region, "Fv" fragments consisting of the variable regions of the heavy and light chains, and recombinant single chain polypeptide molecules in which light and heavy variable regions are connected by a peptide linker (scFv proteins).

The antibody may be any class of antibody, but in a preferred instance the antibody is an IgG antibody.

Another form of an antibody fragment is a peptide comprising one or more complementarity determining regions (CDRs) of an antibody. CDRs (also termed "minimal recognition units" or "hypervariable region") can be obtained by constructing polynucleotides that encode the CDR of interest. Such polynucleotides are prepared, for example, by using the polymerase chain reaction to synthesize the variable region using mRNA of antibody-producing cells as a template (see, for example, Larrick et al., *Methods: A Companion to Methods in Enzymology*, 2:106 (1991); Courtenay-Luck, "Genetic Manipulation of Monoclonal Antibodies," in *Monoclonal Antibodies Production, Engineering and Clinical Application*, Ritter et al. (eds.), page 166, Cambridge University Press (1995); and Ward et al., "Genetic Manipulation and Expression of Antibodies," in *Monoclonal Antibodies: Principles and Applications*, Birch et al., (eds.), page 137, Wiley-Liss, Inc. (1995)).

Anti-sclerostin antibodies may, for instance, bind to sclerostin of SEQ ID NO: 1, or a naturally occurring variant thereof, with an affinity (Kd) of less than or equal to $1\times10^{-7}$M, less than or equal to $1\times10^{-8}$M, less than or equal to $1\times10^{-9}$M, less than or equal to $1\times10^{-10}$ M, less than or equal to $1\times10^{-11}$M, or less than or equal to $1\times10^{-12}$ M. Affinity is determined using a variety of techniques, an example of which is an affinity ELISA assay. In various embodiments, affinity is determined by a BIAcore assay (a surface plasmon resonance assay). In various embodiments, affinity is determined by a kinetic method. In various embodiments, affinity is determined by an equilibrium/solution method. U.S. Patent Publication No. 20070110747 contains additional description of affinity assays suitable for determining the affinity (Kd) of an antibody for sclerostin.

Anti-sclerostin antibodies for use in the inventive method preferably modulate sclerostin function in the cell-based assay described in U.S. Patent Publication No. 20070110747 and/or the in vivo assay described in U.S. Patent Publication No. 20070110747 and/or bind to one or more of the epitopes described in U.S. Patent Publication No. 20070110747 and/or cross-block the binding of one of the antibodies described in U.S. Patent Publication No. 20070110747 and/or are cross-blocked from binding sclerostin by one of the antibodies described in U.S. Patent Publication No. 20070110747 (incorporated by reference in its entirety and for its description of assays for characterizing an anti-sclerostin antibody).

In various embodiments, the anti-sclerostin antibody binds to a sclerostin polypeptide comprising the amino acid sequence set forth in SEQ ID NO: 1 of the Sequence Listing and binds the sequence of SEQ ID NO: 6 (C4GPARLLPNAIGRGKWWRPSGPDFRC5; corresponding to amino acids 86-111 of SEQ ID NO: 1). Alternatively, or in addition, the anti-sclerostin antibody binds to a sclerostin polypeptide comprising the amino acid sequence set forth in SEQ ID NO: 1 and binds the sequence of at least one of SEQ ID NO: 2 (DVSEYSC1RELHFTR; corresponding to amino acids 51-64 of SEQ ID NO: 1), SEQ ID NO: 3 (SAKPVTELVC3SGQC4GPAR; corresponding to amino acids 73-90 of SEQ ID NO: 1), SEQ ID NO: 4 (WWRPSGPDFRC5IPDRYR; corresponding to amino acids 101-117 of SEQ ID NO: 1), SEQ ID NO: 5 (LVASC7KC8KRLTR; corresponding to amino acids 138-149 of SEQ ID NO: 1), SEQ ID NO: 70 (SAKPVTELVC3SGQC4; corresponding to amino acids 73-86 of SEQ ID NO: 1), SEQ ID NO: 71 (LVASC7KC8; corresponding to amino acids 138-144 of SEQ ID NO: 1), SEQ ID NO: 72 (C1RELHFTR; corresponding to amino acids 57-64 of SEQ ID NO: 1), or SEQ ID NO: 73 (C5IPDRYR; corresponding to amino acids 111-117 of SEQ ID NO: 1) within SEQ ID NO: 1. For example, in one aspect, the anti-sclerostin antibody binds a subregion of sclerostin of SEQ ID NO: 1 comprising SEQ ID NOs: 2-5 (and/or SEQ ID NOs: 70-73), optionally in its native three-dimensional conformation. Optionally, the anti-sclerostin antibody binds a peptide consisting of one or more of SEQ ID NO: 2, SEQ ID NO: 3, SEQ ID NO: 4, SEQ ID NO: 5, SEQ ID NO: 6, SEQ ID NO: 70, SEQ ID NO: 71, SEQ ID NO: 72, or SEQ ID NO: 73 of the Sequence Listing (e.g., a peptide consisting of SEQ ID NO: 2, SEQ ID NO: 3, SEQ ID NO: 4, and SEQ ID NO: 5 or a peptide consisting of SEQ ID NO: 70, SEQ ID NO: 71, SEQ ID NO: 72, and SEQ ID NO: 73).

In various aspects, the anti-sclerostin antibody is capable of neutralizing human sclerostin in a MC3T3 cell-based mineralization assay when there is less than a 6-fold excess of moles of sclerostin binding sites per well as compared to the number of moles of sclerostin per well. Mineralization by osteoblast-lineage cells in culture, either primary cells or cell lines, is used as an in vitro model of bone formation. An exemplary cell-based mineralization assay is described in U.S. Patent Publication No. 20070110747 at, e.g., Example 8 (hereby incorporated by reference). MC3T3-E1 cells (Sudo et al., *J. Cell Biol.*, 96:191-198 (1983)) and subclones of the original cell line can form mineral in culture upon growth in the presence of differentiating agents. Such subclones include MC3T3-E1-BF (Smith et al., *J. Biol. Chem.*, 275:19992-20001 (2000)). For both the MC3T3-E1-BF subclone as well as the original MC3T3-E1 cells, sclerostin can inhibit one or more of the sequence of events leading up to and including mineral deposition (i.e., sclerostin inhibits mineralization). Anti-sclerostin antibodies that are able to neutralize sclerostin's inhibitory activity allow for mineralization of the culture in the presence of sclerostin such that there is a statistically significant increase in, e.g., deposition of calcium phosphate (measured as calcium) as compared to the amount of calcium measured in the sclerostin-only (i.e., no antibody) treatment group.

When running the assay with the goal of determining whether a particular anti-sclerostin antibody can neutralize sclerostin, the amount of sclerostin used in the assay desirably is the minimum amount of sclerostin that causes at least a 70%, statistically significant, reduction in deposition of calcium phosphate (measured as calcium) in the sclerostin-only group, as compared to the amount of calcium measured in the no sclerostin group. An anti-sclerostin neutralizing antibody is defined as one that causes a statistically significant increase in deposition of calcium phosphate (measured as calcium) as compared to the amount of calcium measured in the sclerostin-only (i.e., no antibody) treatment group. To determine whether an anti-sclerostin antibody is neutralizing or not, the amount of anti-sclerostin antibody used in the assay needs to be such that there is an excess of moles of sclerostin binding sites per well as compared to the number of moles of sclerostin per well. Depending on the potency of the antibody, the fold excess that may be required can be 24, 18, 12, 6, 3, or 1.5, and one of skill is familiar with the routine practice of testing more than one concentration of binding agent (antibody). For example, a very potent anti-sclerostin neutralizing antibody will neutralize sclerostin when there is less than a 6-fold excess of moles of sclerostin binding sites per well as compared to the number of moles of sclerostin per well. A less potent anti-sclerostin neutralizing antibody will neutralize sclerostin only at a 12, 18 or 24 fold excess.

The anti-sclerostin antibody optionally has an $IC_{50}$ of 100 nM or less, or 75 nM or less, or 50 nM or less, or 25 nM or less for neutralizing human sclerostin in a cell-based assay, such as a bone specific alkaline phosphatase assay, e.g., the bone specific alkaline phosphatase assay described in International Patent Publication No. WO 2008/115732 and U.S. Pat. No. 7,744,874 (incorporated herein by reference in its entirety for its description of cell-based assays and anti-sclerostin antibodies). The bone specific alkaline phosphatase assay is predicated on the ability of sclerostin to decrease BMP-4 and Wnt3a-stimulated alkaline phosphatase levels in the multipotential murine cell line, C2C12. According to WO 2008/115732, a neutralizing anti-sclerostin antibody mediates a dose-dependent increase of alkaline phosphatase activity in this assay.

Alternatively or in addition, the anti-sclerostin antibody has an $IC_{50}$ of 100 nM or less (e.g., 75 nM or less, or 50 nM or less) for neutralizing human sclerostin in a cell-based Wnt signalling assay in HEK293 cell lines, such as the Wnt assay involving Wnt1-mediated induction of STF reporter gene described in, e.g., International Patent Publication No. WO 2009/047356 (incorporated by reference for its discussion of anti-sclerostin antibodies and cell-based assays). Alternatively or in addition, the anti-sclerostin antibody has an $IC_{50}$ of 500 nM or less (e.g., 250 nM or less, 150 nM or less, 100 nM or less, or 50 nM or less) for neutralizing human sclerostin in a BMP2-induced mineralization assay in MC3T3 cells, such as the mineralization assay described in, e.g., International Patent Publication No. WO 2009/047356.

Examples of anti-sclerostin antibodies suitable for use in the context of the invention are described in U.S. Patent Publication Nos. 20070110747 and 20070072797, which are hereby incorporated by reference. In one embodiment of the invention, the anti-sclerostin antibody cross-blocks the binding of at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, or Ab-24 (all of which are described in U.S. Patent Publication No. 20070110747) to sclerostin. Alternatively or in addition, the anti-sclerostin antibody is cross-blocked from binding to sclerostin by at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, or Ab-24 (all of which are described in U.S. Patent Publication No. 20070110747). The terms "cross-block," "cross-blocked," and "cross-blocking" are used interchangeably herein to mean the ability of an antibody to interfere with the binding of other antibodies to sclerostin. The extent to which an antibody is able to interfere with the binding of another to sclerostin, and therefore whether it can be said to cross-block, can be determined using competition binding assays. In some aspects of the invention, a cross-blocking antibody or fragment thereof reduces sclerostin binding of a reference antibody between about 40% and about 100%, such as about 60% and about 100%, specifically between 70% and 100%, and more specifically between 80% and 100%. A particularly suitable quantitative assay for detecting cross-blocking uses a Biacore machine which measures the extent of interactions using surface plasmon resonance technology.

Another suitable quantitative cross-blocking assay uses an ELISA-based approach to measure competition between antibodies in terms of their binding to sclerostin.

Examples of suitable anti-sclerostin antibodies and fragments thereof include antibodies and antibody fragments having one or more of CDR-H1, CDR-H2, CDR-H3, CDR-L1, CDR-L2 and CDR-L3 specifically disclosed in U.S. Patent Publication No. 20070110747. At least one of the regions of CDR-H1, CDR-H2, CDR-H3, CDR-L1, CDR-L2, and CDR-L3 may have at least one amino acid substitution, provided that the antibody retains the binding specificity of the non-substituted CDR. Preferably, the anti-sclerostin antibody is Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, or Ab-24 of U.S. Patent Publication No. 20070110747.

In addition, the anti-sclerostin antibody can comprise at least one CDR sequence having at least 75% identity (e.g., 100% identity) to a CDR selected from SEQ ID NOs: 39, 40, 41, 42, 43, 44, 45, 46, 47, 48, 49, 50, 51, 52, 53, 54, 55, 56, 57, 58, 59, 60, 61, 62, 78, 79, 80, 81, 99, 100, 101, 102, 103, 104, 105, 106, 107, 108, 109, 110, 111, 112, 113, 114, 115, 116, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 351, 352, 353, 358, 359, and 360 provided in the Sequence Listing and disclosed in U.S. Patent Publication No. 20070110747. Preferably, the anti-sclerostin antibody comprises at least one CDR sequence having at least 75% identity to a CDR selected from SEQ ID NOs: 245, 246, 247, 78, 79, 80, 269, 270, 271, 239, 240, and 241, all of which is provided in the Sequence Listing and described in U.S. Patent Publication No. 20070110747. As described in U.S. Patent Publication No. 20070110747, the anti-sclerostin antibody can comprise: a) CDR sequences of SEQ ID NOs:54, 55, and 56 and CDR sequences of SEQ ID NOs:51, 52, and 53; b) CDR sequences of SEQ ID NOs:60, 61, and 62 and CDR sequences of SEQ ID NOs:57, 58, and 59; c) CDR sequences of SEQ ID NOs:48, 49, and 50 and CDR sequences of SEQ ID NOs:45, 46, and 47; d) CDR sequences of SEQ ID NOs:42, 43, and 44 and CDR sequences of SEQ ID NOs:39, 40, and 41; e) CDR sequences of SEQ ID NOs:275, 276, and 277 and CDR sequences of SEQ ID NOs:287, 288, and 289; f) CDR sequences of SEQ ID NOs:278, 279, and 280 and CDR sequences of SEQ ID NOs:290, 291, and 292; g) CDR sequences of SEQ ID NOs:78, 79, and 80 and CDR sequences of SEQ ID NOs: 245, 246, and 247; h) CDR sequences of SEQ ID NOs:81, 99, and 100 and CDR sequences of SEQ ID NOs:248, 249, and 250; i) CDR sequences of SEQ ID NOs:101, 102, and 103 and CDR sequences of SEQ ID NOs:251, 252, and 253; j) CDR sequences of SEQ ID NOs:104, 105, and 106 and CDR sequences of SEQ ID NOs:254, 255, and 256; k) CDR sequences of SEQ ID NOs:107, 108, and 109 and CDR sequences of SEQ ID NOs:257, 258, and 259; l) CDR sequences of SEQ ID NOs:110, 111, and 112 and CDR sequences of SEQ ID NOs:260, 261, and 262; m) CDR sequences of SEQ ID NOs:281, 282, and 283 and CDR sequences of SEQ ID NOs:293, 294, and 295; n) CDR sequences of SEQ ID NOs:113, 114, and 115 and CDR sequences of SEQ ID NOs:263, 264, and 265; o) CDR sequences of SEQ ID NOs:284, 285, and 286 and CDR sequences of SEQ ID NOs:296, 297, and 298; p) CDR sequences of SEQ ID NOs:116, 237, and 238 and CDR sequences of SEQ ID NOs:266, 267, and 268; q) CDR sequences of SEQ ID NOs:239, 240, and 241 and CDR sequences of SEQ ID NOs:269, 270, and 271; r) CDR sequences of SEQ ID NOs:242, 243, and 244 and CDR sequences of SEQ ID NOs:272, 273, and 274; or s) CDR sequences of SEQ ID NOs:351, 352, and 353 and CDR sequences of SEQ ID NOs:358, 359, and 360.

The anti-sclerostin antibody also can comprise at least one CDR sequence having at least 75% identity (e.g., 100% identical) to a CDR selected from CDR-H1, CDR-H2, CDR-H3, CDR-L1, CDR-L2, and CDR-L3 wherein CDR-H1 has the sequence given in SEQ ID NO: 245, CDR-H2 has the sequence given in SEQ ID NO: 246, CDR-H3 has the sequence given in SEQ ID NO: 247, CDR-L1 has the sequence given in SEQ ID NO: 78, CDR-L2 has the sequence given in SEQ ID NO: 79 and CDR-L3 has the sequence given in SEQ ID NO: 80, all of which is provided in the Sequence Listing and described in U.S. Patent Publication No. 20070110747. The anti-sclerostin antibody, in various aspects, comprises two of the CDRs or six of the CDRs. Optionally, the anti-sclerostin antibody comprises heavy chains comprising SEQ ID NO: 378 and light chains comprising SEQ ID NO 376 provided in the Sequence Listing.

The anti-sclerostin antibody also can comprise at least one CDR sequence having at least 75% identity (e.g., 100% identical) to a CDR selected from CDR-H1, CDR-H2, CDR-H3, CDR-L1, CDR-L2, and CDR-L3 wherein CDR-H1 has the sequence given in SEQ ID NO: 269, CDR-H2 has the sequence given in SEQ ID NO: 270, CDR-H3 has the sequence given in SEQ ID NO: 271, CDR-L1 has the sequence given in SEQ ID NO: 239, CDR-L2 has the sequence given in SEQ ID NO: 240 and CDR-L3 has the sequence given in SEQ ID NO 241, all of which is provided in the Sequence Listing and described in U.S. Patent Publication No. 20070110747. The anti-sclerostin antibody, in various aspects, comprises two of the CDRs or six of the CDRs. Optionally, the anti-sclerostin antibody comprises heavy chains comprising SEQ ID NO: 366 and light chains comprising SEQ ID NO 364 provided in the Sequence Listing.

Alternatively, the anti-sclerostin antibody can have a heavy chain comprising CDR's H1, H2, and H3 and comprising a polypeptide having the sequence provided in SEQ ID NO: 137 or a variant thereof in which said CDR's are at least 75% identical (e.g., 100% identical) to SEQ ID NO: 245, 246, and 247, respectively, and a light chain comprising CDR's L1, L2 and L3 and comprising a polypeptide having the sequence provided in SEQ ID NO: 133 or a variant thereof in which said CDR's are at least 75% identical (e.g., 100% identical) to SEQ ID NO: 78, 79, and 80, respectively (as described in U.S. Patent Publication No. 20070110747).

The anti-sclerostin antibody may have a heavy chain comprising CDR's H1, H2, and H3 and comprising a polypeptide having the sequence provided in SEQ ID NO: 145 or 392 or a variant thereof in which said CDR's are at least 75% identical (e.g., 100% identical) to SEQ ID NO: 245, 246, and 247, respectively, and a light chain comprising CDR's L1, L2, and L3 and comprising a polypeptide having the sequence provided in SEQ ID NO: 141 or a variant thereof in which said CDR's are at least 75% identical (e.g., 100% identical) to SEQ ID NO: 78, 79, and 80, respectively (as described in U.S. Patent Publication No. 20070110747).

The anti-sclerostin antibody may have a heavy chain comprising CDR's H1, H2, and H3 and comprising a polypeptide having the sequence provided in SEQ ID NO: 335, 331, 345, or 396 (provided in the Sequence Listing) or a variant of any of the foregoing in which said CDR's are at least 75% (e.g., 100% identical) identical to SEQ ID NO: 269, 270, and 271, respectively, and a light chain comprising CDR's L1, L2, and L3 and comprising a polypeptide having the sequence provided in SEQ ID NO: 334 or 341 (provided in the Sequence Listing) or a variant of any of the foregoing in which said CDR's are at least 75% identical (e.g., 100% identical) to SEQ ID NO: 239, 240, and 241, respectively (as described in U.S. Patent Publication No. 20070110747). All combinations of the heavy and light chain sequences are contemplated (e.g., heavy chains comprising SEQ ID NO: 335 and light chains comprising SEQ ID NO: 334; heavy chains comprising SEQ ID NO: 331 and light chains comprising SEQ ID NO: 334 or 341; and heavy chains comprising SEQ ID NO: 345 or 396 and light chains comprising SEQ ID NO: 341).

Alternatively, the anti-sclerostin antibody has a heavy chain comprising a polypeptide having the sequence provided in SEQ ID NO:137, and a light chain comprising a polypeptide having the sequence provided in SEQ ID NO:133; a heavy chain comprising a polypeptide having the sequence provided in SEQ ID NO:145 or 392, and a light chain comprising a polypeptide having the sequence provided in SEQ ID NO: 141; a heavy chain comprising a polypeptide having the sequence provided in SEQ ID NO:335, and a light chain comprising a polypeptide having the sequence provided in SEQ ID NO:334; a heavy chain comprising a polypeptide having the sequence provided in SEQ ID NO:331, and a light chain comprising a polypeptide having the sequence provided in SEQ ID NO:341; or a heavy chain comprising a polypeptide having the sequence provided in SEQ ID NO:345 or 396, and a light chain comprising a polypeptide having the sequence provided in SEQ ID NO:341 (provided in the Sequence Listing and as described in U.S. Patent Publication No. 20070110747).

Examples of anti-sclerostin antibodies also include, but are not limited to, the anti-sclerostin antibodies disclosed in International Patent Publication Nos. WO 2008/092894, WO 2008/115732, WO 2009/056634, WO 2009/047356, WO 2010/100200, WO 2010/100179, WO 2010/115932, and WO 2010/130830 (each of which is incorporated by reference herein in its entirety), such as an anti-sclerostin antibody comprising CDRs of SEQ ID NOs: 20-25 of International Patent Publication No. WO 2008/115732 (FIG. 8), an anti-sclerostin antibody comprising CDRs of SEQ ID NOs: 26-31 of International Patent Publication No. WO 2008/115732 (FIG. 8), an anti-sclerostin antibody comprising CDRs of SEQ ID NOs: 32-37 of International Patent Publication No. WO 2008/115732 (FIG. 8), an anti-sclerostin antibody comprising CDRs of SEQ ID NOs: 4, 15, 26, 37, 48, and 59 of International Patent Publication No. WO 2009/047356 (FIG. 9), or an anti-sclerostin antibody comprising the amino acid sequence of at least one of SEQ ID NOs: 135-143, 153-161, or 171-179 of International Patent Publication No. WO 2010/130830 (FIG. 10).

In one instance, the antibody employed comprises CDRs of SEQ ID NOs: 20-25 of International Patent Publication No. WO 2008/115732 (FIG. 8), CDRs of SEQ ID NOs: 26-31 of International Patent Publication No. WO 2008/115732 (FIG. 8), or CDRs of SEQ ID NOs: 32-37 of International Patent Publication No. WO 2008/115732 (FIG. 8). In another instance, the antibody comprises CDRs of SEQ ID NOs: 4, 15, 26, 37, 48, and 59 of International Patent Publication No. WO 2009/047356 (FIG. 9). In a further instance, the antibody comprises the amino acid sequence of at least one of SEQ ID NOs: 135-143, 153-161, or 171-179 of International Patent Publication No. WO 2010/130830 (FIG. 10). The disclosure of WO 2008/115732, WO 2009/047356 and WO 2010/130830 is incorporated herein in its entirety, including specifically the referenced CDR sequences and description of antibodies comprising the CDR sequences.

In one instance, the antibody employed may be an antibody capable of cross-blocking any of those antibodies specified herein and in particular an antibody that cross-blocks any of Ab-13, Ab-C and Ab-D referred to herein. In this regard, the anti-sclerostin antibody optionally cross-blocks the binding of a second antibody to sclerostin of SEQ ID NO: 1 or is cross-blocked from binding to sclerostin of SEQ ID NO: 1 by the second antibody, wherein the second antibody comprises light chains comprising the amino acid sequence set forth in SEQ ID NO: 205 and heavy chains comprising the amino acid sequence set forth in SEQ ID NO: 209; light chains comprising the amino acid sequence set forth in SEQ ID NO: 15 and heavy chains comprising the amino acid sequence set forth in SEQ ID NO: 19; or light chains comprising the amino acid sequence set forth in SEQ ID NO: 7 and heavy chains comprising the amino acid sequence set forth in SEQ ID NO: 11 (provided in the Sequence Listing).

Additional Treatments for Bone Disorders

In some instances, the subject may be administered an additional agent to treat their bone disorder. The subject may be, for instance, treated with any other therapy for treating bone disorders. For example, the additional treatment may be at the same time, overlapping with, or alternating with, the anti-sclerostin antibody treatment of the invention. In one instance, the subject may be administered vitamin D.

In one preferred instance, the second therapeutic agent is given in the dosing holiday for the anti-sclerostin antibody. Hence, whilst the dosing holiday allows resistance to the anti-sclerostin antibody to diminish, the subject is treated with the second therapeutic agent in the dosing holiday. Alternating treatments in that way may, in some instances, helps avoid possible detrimental effects associated with giving the other treatment for an extended, unbroken, period.

In one instance, the other therapeutic agent may be a bone resorption inhibitor. For instance, any suitable anti-resorptive may be employed. In one preferred instance, the bone resorption inhibitor is a bisphosphonate, particularly a nitrogen containing bisphosphonate. Examples of bisphosphonates include, but are not limited to, Alendronate, bonefos ciodronate, etidronate, ibandronic acid, olpadronate, neridronate, risedronate sodium, skelid, and zoledronic acid. In one preferred instance, the bisphosphonate is zoledronic acid. Bisphosphonates which may be employed include, for instance, Actonel, Aclasta™/Reclast™, Boniva™/Bonviva™, Fosamax™, and Zometa™. An advantage of alternating between the anti-sclerostin antibody and bisphosphonate is that it may help avoid possible side effects arising from the subject being treated with bisphosphonates for a prolonged period. Hence, alternating helps avoid such side-effects, whilst also addressing the problem of resistance developing to the antibody.

Selected estrogen receptor modulators may be employed as bone resorption inhibitors, for instance, arzoxifene, bazedoxifene, FC 1271, lasofoxifene, raloxifene, and Tibolone are examples of suitable SERMs. Other bone resorption inhibitors which may be used include estrogen and calcitonin, with examples of calcitonin including salmon calcitonins, such as Miacalcin™.

Strontium compounds may be employed as the bone resorption inhibitor and in one particular instance the compound is strontium ranelate. In other instances, the additional treatment administered may be PTH, in particular recombinant parathyroid hormone releasing peptide.

In various embodiments, the bone resorption inhibitor is a RANKL inhibitor, such as an anti-RANKL antibody. In one preferred instance, the bone resorption inhibitor employed may be denosumab.

In some instances the anti-resorptive employed is not a bisphosphonate. Examples, of such agents which may be employed include PROLIA®, calcitonin, and cathepsin K inhibitors (e.g., odanacatib).

In various embodiments, the second therapeutic agent is an anabolic agent, such as parathyroid hormone or analogs thereof (e.g., teriparatide (FORTEO®).

In one case, a bone resorption inhibitor may be administered at the same time, or approximately the same time, as the antibody, or so the two therapies overlap. It may be that the bone resorption inhibitor is given to help prolong further the effect of the anti-sclerostin antibody by reducing the breakdown of bone that the antibody has stimulated and in particular where the compound is a bisphosphonate.

Disorders to be Treated

The invention is typically used to treat or help prevent a bone disorder. The invention may be, for example, employed to increase at least one of bone formation, bone mineral density, bone mineral content, bone mass, bone quality and bone strength. Hence, in one instance, the disorder to be treated via the invention is a bone disorder associated with at least one of low bone formation, low bone mineral density, low bone mineral content, low bone mass, low bone quality and low bone strength in a mammalian subject.

The disorder may be a bone-related disorder associated with abnormal osteoblast or osteoclast activity. Examples of disorders associated with bone loss which may be treated include achondroplasia, cleidocranial dysostosis, enchondromatosis, fibrous dysplasia, Gaucher's Disease, hypophosphatemic rickets, Marfan's syndrome, multiple hereditary exotoses, neurofibromatosis, osteogenesis imperfecta, osteopetrosis, osteopoikilosis, sclerotic lesions, pseudoarthrosis, pyogenic osteomyelitis, periodontal disease, anti-epileptic drug induced bone loss, primary and secondary hyperparathyroidism, familial hyperparathyroidism syndromes, weightlessness induced bone loss, osteoporosis in men, postmenopausal bone loss, osteoarthritis, renal osteodystrophy, infiltrative disorders of bone, oral bone loss, osteonecrosis of the jaw, juvenile Paget's disease, melorheostosis, metabolic bone diseases, mastocytosis, sickle cell anemia/disease, organ transplant related bone loss, kidney transplant related bone loss, systemic lupus erythematosus, ankylosing spondylitis, epilepsy, juvenile arthritides, thalassemia, mucopolysaccharidoses, Fabry Disease, Turner Syndrome, Down Syndrome, Klinefelter Syndrome, leprosy, Perthe's Disease, adolescent idiopathic scoliosis, infantile onset multi-system inflammatory disease, Winchester Syndrome, Menkes Disease, Wilson's Disease, ischemic bone disease (such as Legg-Calve-Perthes disease and regional migratory osteoporosis), anemic states, conditions caused by steroids, glucocorticoid-induced bone loss, heparin-induced bone loss, bone marrow disorders, scurvy, malnutrition, calcium deficiency, osteoporosis, osteopenia, alcoholism, chronic liver disease, postmenopausal state, chronic inflammatory conditions, rheumatoid arthritis, inflammatory bowel disease, ulcerative colitis, inflammatory colitis, Crohn's disease, oligomenorrhea, amenorrhea, diabetes mellitus, hyperthyroidism, thyroid disorders, parathyroid disorders, Cushing's disease, acromegaly, hypogonadism, immobilization or disuse, reflex sympathetic dystrophy syndrome, regional osteoporosis, osteomalacia, bone loss associated with joint replacement, HIV associated bone loss, bone loss associated with loss of growth hormone, bone loss associated with cystic fibrosis, chemotherapy-associated bone loss, tumor-induced bone loss, cancer-related bone loss, hormone ablative bone loss, multiple myeloma, drug-induced bone loss, anorexia nervosa, disease-associated facial bone loss, disease-associated cranial bone loss, disease-associated bone loss of the jaw, disease-associated bone loss of the skull, bone loss associated with aging, facial bone loss associated with aging, cranial bone loss associated with aging, jaw bone loss associated with aging, skull bone loss associated with aging, and bone loss associated with space travel. Bone loss, decreased bone mineral density, decreased bone volume, and/or decreased bone mineral content associated with these disorders may be treated in the context of the invention. In one instance, the subject to be treated may be pregnant. For instance, the invention may be employed to help in pregnancy-related bone loss. The invention may be used to slow, or reverse, bone loss in general.

In one instance, the condition to be treated is not bone fracture. In one particularly preferred instance, the condition to be treated is osteoporosis or osteopenia. In one instance, the subject to be treated is a postmenopausal woman, for instance, one with osteoporosis, particularly such a subject who is at increased, or high risk, for fracture, or has failed or is intolerant to other available osteoporosis therapy. In further instances, the invention may be employed in improving the outcome in a mammal undergoing one or more of an orthopedic procedure, dental procedure, implant surgery, joint replacement, bone grafting, bone cosmetic surgery and bone repair such as fracture healing, nonunion healing, delayed union healing and facial reconstruction.

Administration

Various routes of administering an antibody to a subject are known in the art and discussed in, e.g., U.S. Patent Publication No. 20070110747. For example, in various embodiments, it is desirable to deliver a pharmaceutical composition comprising the anti-sclerostin antibody subcutaneously, parenterally, intravenously, intramuscularly, or even intraperitoneally. Such approaches are well known to the skilled artisan, some of which are further described, for example, in U.S. Pat. Nos. 5,543,158; 5,641,515; and 5,399,363. Optionally, the anti-sclerostin antibody is administered subcutaneously.

Illustrative physiologically-acceptable (e.g., pharmaceutical) forms suitable for use include sterile aqueous solutions or dispersions and sterile powders for the extemporaneous preparation of sterile injectable solutions or dispersions (for example, see U.S. Pat. No. 5,466,468). The form must be sterile and is desirably fluid to the extent that easy syringability exists (i.e., is not excessively viscous so as to prevent passage through a syringe). A pharmaceutical composition comprising the anti-sclerostin antibody may be placed within containers (e.g., vials or syringes), along with packaging material that provides instructions regarding the use of such pharmaceutical compositions. Generally, such instructions will include a tangible expression describing the reagent concentration, as well as within certain embodiments, relative amounts of excipient ingredients or diluents (e.g., water, saline or PBS) that may be necessary to reconstitute the pharmaceutical composition. In one instance, where the antibody is to be administered with an additional treatment for the bone disorder, the two may be formulated or packaged together, optionally with instructions setting out a method of the invention.

All of the references cited herein, including patents, patent applications, literature publications, and the like, are hereby incorporated by reference.

While this invention has been described with an emphasis upon preferred embodiments, it will be obvious to those of ordinary skill in the art that variations of the preferred compounds and methods may be used and that it is intended that the invention may be practiced otherwise than as specifically described herein. Accordingly, this invention includes all modifications encompassed within the spirit and scope of the invention as defined by the following claims.

The invention is further described in the following examples. The example serves only to illustrate the invention and is not intended to limit the scope of the invention in any way.

EXAMPLES

Materials and Methods
Animals

Balb/c female mice obtained from Charles River UK (8-10 weeks of age at the start of the experiments) were maintained and studied in a manner in compliance with UK Home Office regulations.

The antibody employed in the present Examples was Scl-AbI (Eddleston et al, 2009, *J Bone MinerRes*, 24:1662-71—which is incorporated herein in its entirety). Scl-AbI was dosed at 10 mg/kg subcutaneously (control animals received PBS) at the time points showed in the Figures. Blood samples (tail tip bleeds) were taken mid-morning where indicated and frozen at −20° C. until assayed. At certain time points terminal blood samples were removed from euthanized animals to provide larger blood samples for assay.

Measurement of P1NP

P1NP was measured using a kit supplied ImmunoDiagnostic Systems (catalogue no. AC-33F1) according to the manufacturers recommended method.

Measurement of BMD

Animals were anesthetized by isofluorane inhalation. After being placed under general anesthesia, the mice were scanned on a Lunar PIXImus (GE Medical Systems) at the times shown.

Results

Determining P1NP Peak Levels Following Dosing

A preliminary experiment established that, following a subcutaneous dose of the anti-sclerostin antibody (10 mg/kg), peak P1NP levels were seen at day 4. This time point was used to monitor the P1NP response in animals subject to multiple doses of Scl-Ab, as discussed further below.

FIG. 1 shows the results of the preliminary experiment. P1NP levels for two mice dosed subcutaneously with 10 mg/kg of anti-sclerostin on day 0 are shown (square and diamond symbols). The kinetics of Scl-AbI following a single subcutaneous dose of 10 mg/kg are also shown in FIG. 1 (triangular symbols).

Multiple Dosing Experiments

Three groups of mice were established, the first group of mice (group A, n=10) was dosed with PBS on days 0, 7, 14, 21 and 28. The second group of mice (group B, n=20) was dosed with Scl-AbI (10 mg/kg, s.c.) on days 0, 7, 14, 21, and 28. The third group of mice (group C) provided a pool of aged matched control animals to determine the P1NP response in mice that had not previously been exposed to Scl-AbI.

Mice in group C were generally dosed with PBS on the same schedule as animals in groups A and B, except that on days 14 and 28 a subgroup of mice from group C (n=5 at each time point) were dosed with Scl-AbI (10 mg/kg s.c.) and the circulating P1NP levels measured 4 days later. These subgroups allowed assessment of the P1NP response in animals that were aged matched with the animals in group B, but were receiving Scl-AbI for the first time (as opposed to the repeat dosing of group B animals).

Figure 2:
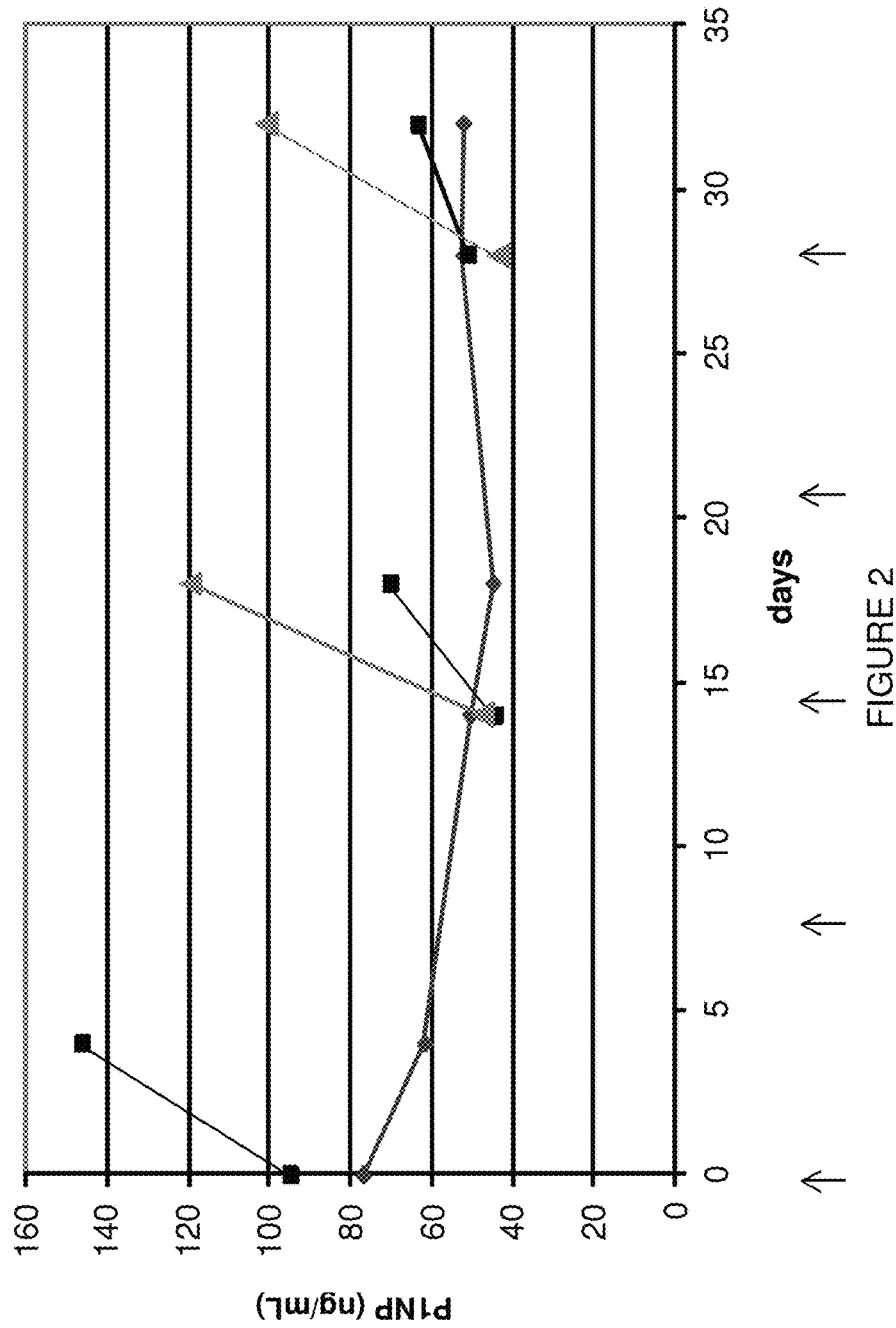
FIG. 2 shows how P1NP response to anti-sclerostin antibodies falls after multiple doses of antibody. P1NP levels are shown for group A mice administered saline alone (diamond symbols), group B mice (square symbols) administered subcutaneously 10 mg/kg anti-sclerostin antibody at the time points indicated at the bottom of the graph and group C mice (triangular symbols) administered saline, except for a single dose of antibody at the time-point depicted. The statistics use an unpaired T test (two tailed) looking at difference of absolute values at day of test. For the results shown the group B mice were administered antibody doses at days 0, 7, 14, 21 and 28, with the single doses for the group C subgroups administered at either day 14 or 28.

Blood samples were taken on days 0, 14, 18, 28 and 32 and circulating P1NP levels measured. FIG. 2 shows the P1NP levels in the different groups of animals. The results for group A (diamond symbols), group B (square symbols) and the subgroup of group C receiving the antibody at day 14 or 28 (triangular symbols) are shown in FIG. 2.

FIG. 2 illustrates a number of points. Firstly, P1NP levels in the PBS treated group (group A) fall with time. As the rate of bone synthesis would be expected to fall with age in the control group, that result was not unexpected. Secondly, the P1NP levels in group B mice (the group receiving multiple doses of Scl-AbI) at day 18 and day 32 (both time points are 4 days after receiving a dose of Scl-Ab) are significantly lower than the levels in mice from group C dosed with Scl-AbI (for the first time) at the same time points. This indicates that the P1NP response in mice receiving multiple doses of Scl-Ab (group B) is blunted compared with the response seen in age-matched mice dosed with Scl-Ab for the first time.

Figure 3:
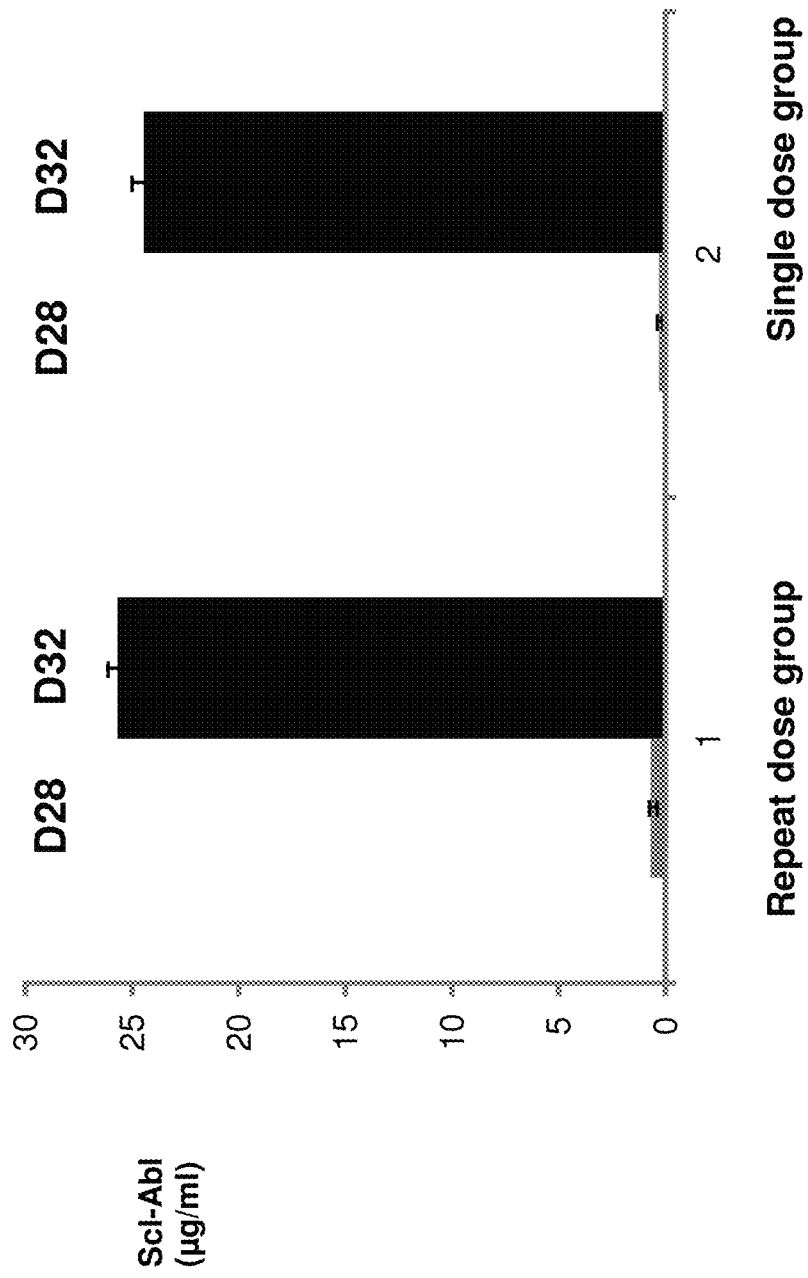
FIG. 3 shows that the decline in plasma P1NP levels after multiple doses of antibody is not due to more rapid elimination of the antibody in the multiple dosed group. The level of antibody is shown for the repeat dose group B and single dose group C immediately before a dose of 10 mg/kg of antibody given subcutaneously on day 28 and the level four days after the dose of antibody at day 32 (mean and SEM levels).

In order to determine if the result seen was due to reduced exposure to anti-sclerostin antibody in those mice receiving multiple doses, anti-sclerostin antibody levels were measured immediately prior to dosing on day 28 and four days afterwards on day 32 in mice from group B and those from group C given the single dose at day 28. FIG. 3 shows the results obtained and that the plasma levels of Scl-Ab on days 28 and 32 are not significantly different in mice from group B and group C, suggesting that the decreased P1NP response in the group B mice is not due to reduced exposure to Scl-Ab (as might happen due to rapid clearance if mice in group B mounted an immune response to Scl-Ab).

Figure 4:
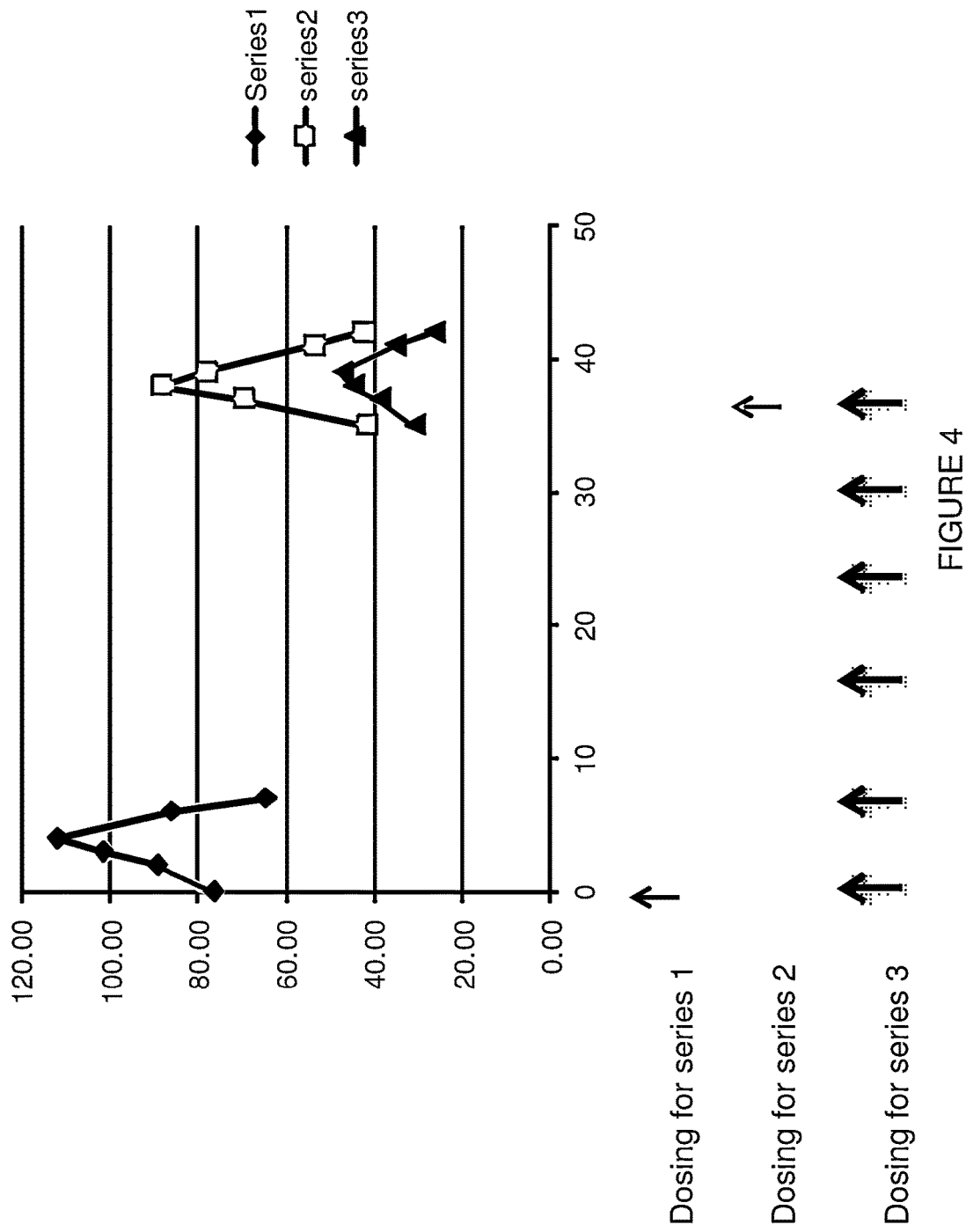
FIG. 4 shows the kinetics of P1NP induction are the same in mice given a single dose or multiple doses of anti-sclerostin antibody, only the magnitude of the P1NP induction is different between the two groups. The P1NP levels for series 1 (diamond symbols) and series 2 (square symbols) are shown where the mice were given a single dose of anti-sclerostin antibody, as well as the levels for the series 3 mice (triangular symbols) given multiple doses of anti-sclerostin antibody. The time of the administration of the antibody is shown by the arrows under the graph.

The kinetics of P1NP induction was compared, and is depicted in FIG. 4, for mice receiving a single dose of sclerostin at either day 0 or 35 (series 1—diamonds and series 2—squares), with mice receiving multiple doses (series 3—triangles). FIG. 4 shows that although the P1NP response is lower in mice receiving multiple doses of Scl-Ab, the peak of the response still occurs around day 4 and so it is not the kinetics of the P1NP response to the anti-sclerostin antibody which are changed, only the magnitude.

Dosing Holidays

Figure 5:
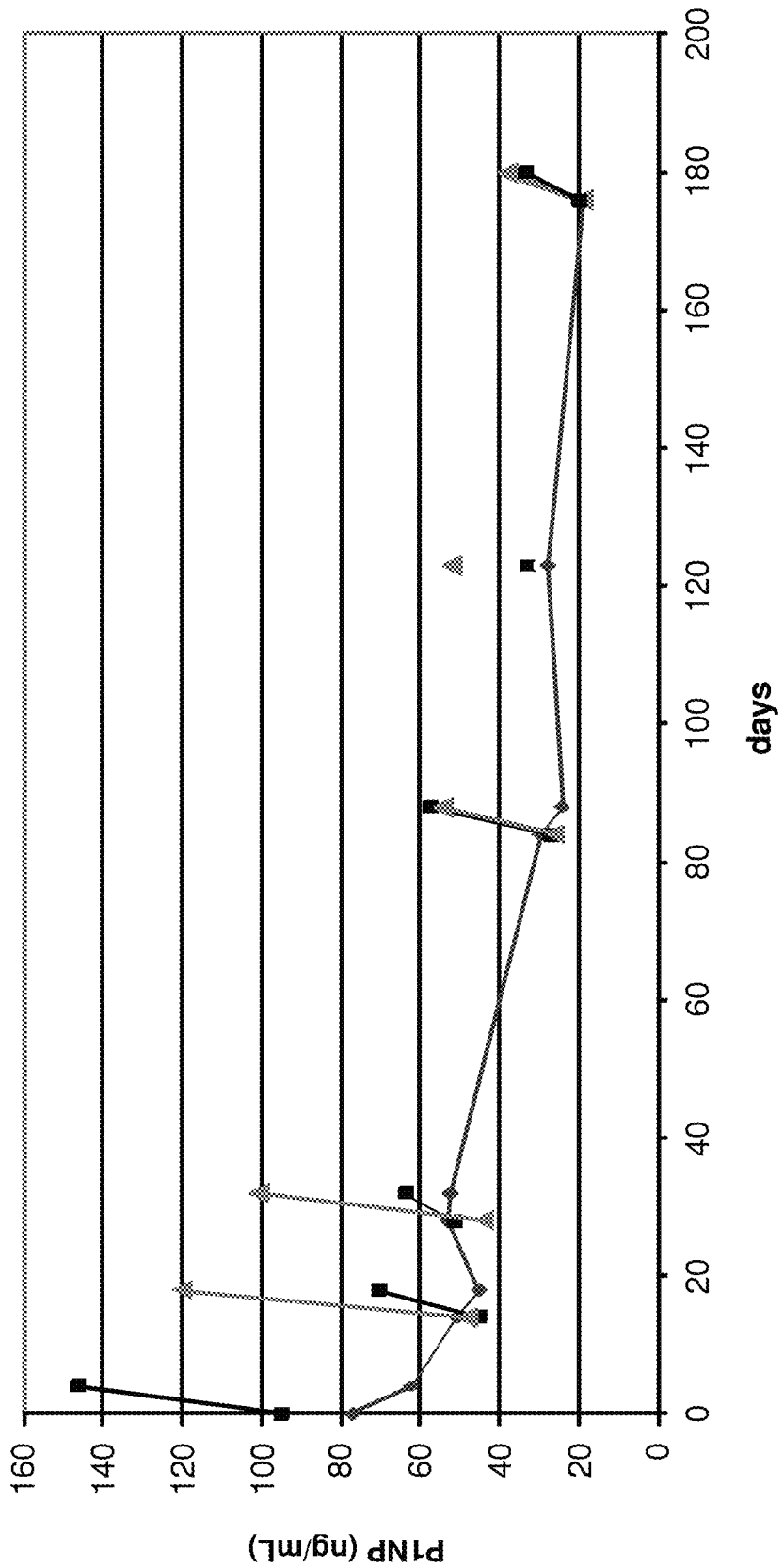
FIG. 5 shows P1NP levels in groups A, B and subgroups of group C given a single dose of antibody at the depicted time point. The symbols are the same as indicated above for FIG. 2. The dosing schedule for group B is shown by arrows at the bottom of the graph and corresponds to doses at days 0, 7, 14, 21 and 28 and days 84, 91, 98, 105, 112 119 and 176 (no baseline sample was taken on day 119). Hence, there were dosing holidays between days 28 and 84 and also days 119 and 176. The single doses for the group C subgroups were at days 14, 28, 84, 119 and 176. The statistics use an unpaired T test (two tailed) looking at difference of absolute values at day of test.

The experiment shown in FIG. 2 was continued and the data from the whole experiment is shown in FIG. 5. Again, the results for group A are shown as diamond symbols, those for group B as square symbols and the single dose subgroups of group C as triangular symbols. The arrows at the bottom of the graph show the time of dosing for the group B animals. It can be seen from FIG. 5 that in group A animals (dosed only with PBS) P1NP levels fall until day 84 after which they reach a fairly stable plateau until the end of the experiment. After the dose of Scl-Ab at day 28 mice in group B were put on a dosing holiday with no further dosing of Scl-Ab until day 84. At this time point a sub-group of aged-matched animals (from group C) were also dosed with Scl-Ab. Surprisingly, the levels of P1NP at day 88 were not significantly different in animals that had received multiple doses of Scl-Ab and those receiving Scl-Ab for the first time. The results indicates that a dosing holiday allows reversal of the resistance (or tachyphylaxis) that develops in mice exposed to multiple doses of Scl-Ab.

Mice in group B received doses of Scl-Ab (10 mg/kg s.c) at days 91, 98, 105, 112 and 119. A sub-group of mice from pool C also received Scl-Ab on day 119. FIG. 5 shows that the P1NP levels in the group B mice were significantly lower than those in the age-matched mice receiving Scl-Ab for the first time. These data show that even after an initial dosing holiday to reverse P1NP tachyphylaxis in the group B mice, the tachyphylactic state re-occurs after multiple doses of Scl-Ab.

Following the dose of Scl-Ab at day 119 the mice in group B were given a second dosing holiday until day 176 when they were dosed again with Scl-Ab (10 mg/kg s.c). At the same time point a subgroup of aged-matched animals from pool C were dosed with Scl-Ab (10 mg/kg s.c) for the first time. Measurement of circulating P1NP levels on day 180 show that there is no significant difference in the PINP levels in the two groups indicating that a second dosing holiday again reversed the P1NP tachyphylaxis in the animals receiving multiple doses of Scl-Ab.

Figure 6:
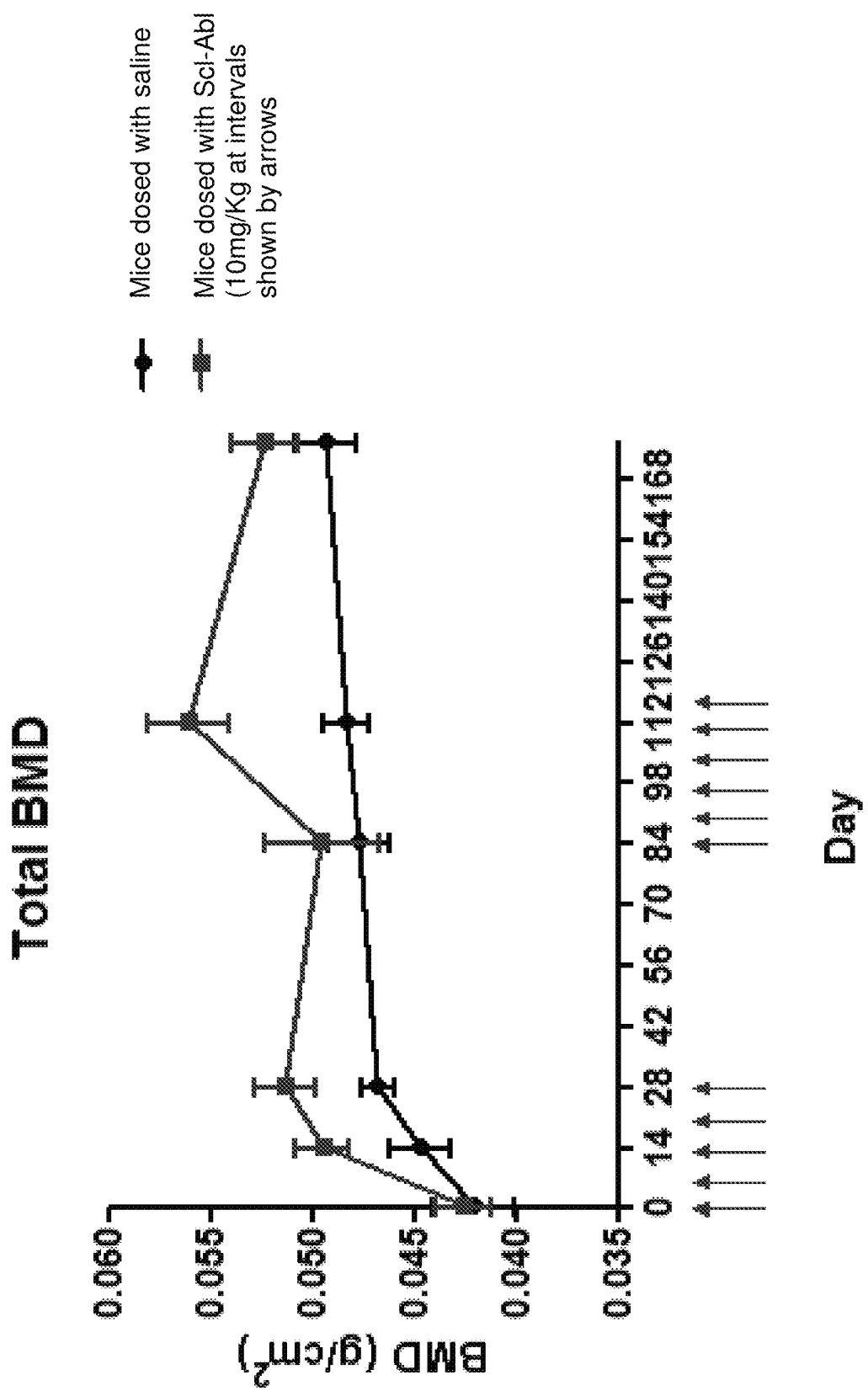
FIG. 6 shows bone mineral density in group A mice (circular symbols) and group B mice (square symbols). The dosing schedule for the group B animals is shown at the bottom of the graph.

Bone mineral density (BMD) was measure in group A and B animals. FIG. 6 shows the results obtained and illustrates that following multiple doses of Scl-Ab the BMD in group B animals increased significantly compared to animals in group A (receiving only saline). BMD declined when Scl-Ab dosing was stopped (after day 28) but again increased when dosing was re-started at day 84 after the dosing holiday.

Figure 11B:
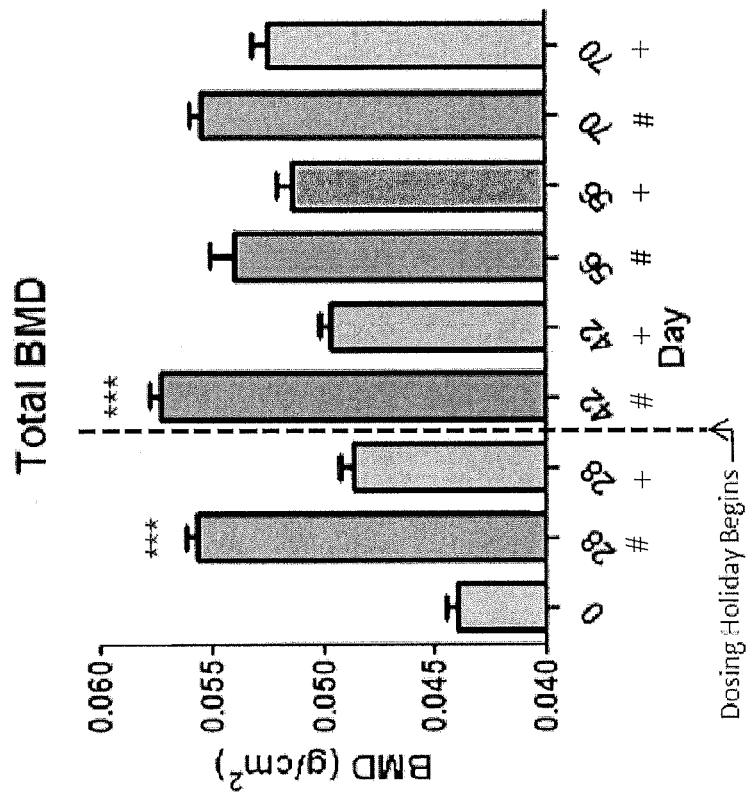
FIG. 11B is a bar graph illustrating total bone mineral density (BMD; g/cm2; y-axis) measured at various time points (days, x-axis). Bars denoted "#" correspond to measurements taken in mice receiving five weekly doses of anti-sclerostin antibody (fifth dose administered on day 28) followed by a single dose of anti-sclerostin antibody on days 42, 56, or 70 (corresponding to a two week, four week, or six week holiday, respectively). Bars denoted "+" correspond to measurements taken in mice receiving a single dose of anti-sclerostin antibody on days 28, 42, 56, or 70 of the study.
Figure 11A:
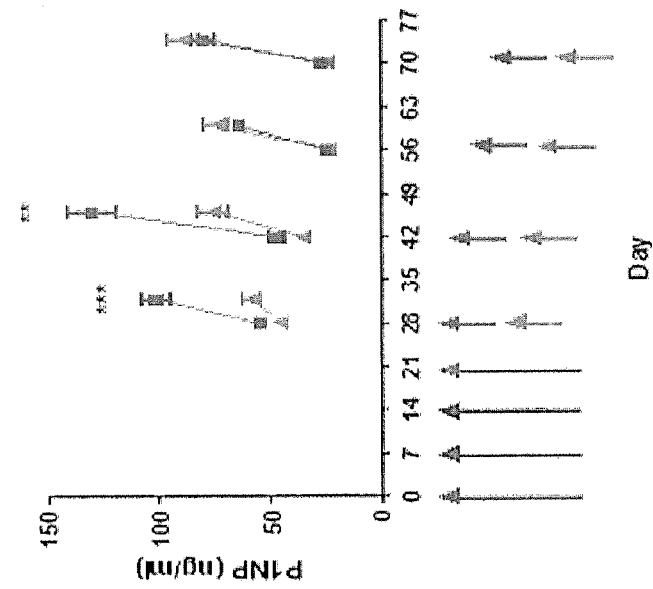
FIG. 11A is a graph illustrating P1NP levels in mice receiving five weekly doses of anti-sclerostin antibody followed by a single dose of anti-sclerostin antibody after a two week (administration on day 42), four week (administration on day 56), or six week (administration on day 70) holiday (triangle symbols) and age-matched mice receiving a single dose of anti-sclerostin antibody on day 28, day 42, day 46, or day 70 (square symbols). P1NP levels (ng/ml) are depicted on the y-axis, and day of the study is depicted on the x-axis.

To further study the duration of tachyphylaxis associated with multiple doses of Scl-Ab, mice were given five weekly doses of Scl-Ab and a further dose after a two week, four week, or six week holiday (Group 1). In other words, subjects in Group 1 received a dose of Scl-Ab on days 0, 7, 14, 21, and 28 of the study, and a subsequent dose on one of days 42, 56, or 70. For comparison, age-matched subjects, previously treated only with saline, were administered a single dose of Scl-Ab on day 28, 42, 56, or 70 (Group 2). Thus, Group 2 mice received only one dose of Scl-Ab, whereas Group 1 mice received multiple doses, optionally with a holiday before the final dose. P1NP levels were measured the day of antibody administration and one week after, and the responses of each group was compared (FIG. 11A). While P1NP levels increased in response to antibody administration in all groups, the increase in P1NP levels in subjects receiving a first dose of Scl-Ab on days 28 and 42 (Group 2) was greater than the increase in P1NP levels in mice previously treated with antibody (Group 1). Among Group 1 subjects, Scl-Ab administration triggered a greater increase in P1NP in subjects administered the dose after a two week holiday (day 42) compared to subjects receiving the dose at the end of the five week regimen (day 28). As illustrated in FIG. 11A, full responsiveness to the Scl-Ab appeared to return after four weeks without dosing (i.e., a four week holiday). The level of marker increase in Group 1 and Group 2 subjects administered Scl-Ab at day 56 (four week holiday) and day 70 (six week holiday) was similar. FIG. 11B shows the BMD in these mice; bars denoted "#" correspond to Group 1 subjects and bars denoted "+" correspond to Group 2 subjects. Hence, overall, the results obtained show that cycles of a series of doses followed by a dosing holiday may be employed to avoid the development of resistance to the anti-sclerostin antibody.

SEQUENCE LISTING (809 sequences)

SEQ ID NO: 1 - protein, 190 aa, Homo sapiens
QGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 2 - protein, 14 aa, Homo sapiens
DVSEYSCRELHFTR

SEQ ID NO: 3 - protein, 16 aa, Homo sapiens
SAKPVTELVCSGQCGP

SEQ ID NO: 4 - protein, 17 aa, Homo sapiens
WWRPSGPDFRCIPDRYR

SEQ ID NO: 5 - protein, 12 aa, Homo sapiens
LVASCKCKRLTR

SEQ ID NO: 6 - protein, 26 aa, Homo sapiens
CGPARLLPNAIGRGKWWRPSGPDFRC

SEQ ID NO: 7 - protein, 214 aa, Mus musculus
DVQMIQSPSSLSASLGDIVTMTCQASQGTSINLNWFQQKPGKAPKLLIYGSSNLEDGVPSRFSGSRYGTDFTLTISSLEDEDLATYFCLQHSYLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 8 - DNA, 645 bp, Mus musculus
gatgtccagatgattcagtctccatcctccctgtctgcatctttgggagacatagtcaccatgacttgccaggcaagtcagggcactagcattaatttaaactggtttcagcaaaaaccagggaaggctcctaagctcctgatctatggttcaagcaacttggaagatggggtcccatcaaggttcagtggcagtagatatgggacagatttcactctcaccatcagcagcctggaggatgaagatctggcaacttatttctgtctacaacatagttatctcccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 9 - protein, 236 aa, Mus musculus
MNTRAPAEFLGFLLLWFLGARCDVQMIQSPSSLSASLGDIVTMTCQASQGTSINLNWFQQKPGKAPKLLIYGSSNLEDGVPSRFSGSRYGTDFTLTISSLEDEDLATYFCLQHSYLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 10 - DNA, 711 bp, Mus musculus
atgaacacgagggcccctgctgagttccttgggttcctgttgctctggtttttaggtgccagatgtgatgtccagatgattcagtctccatcctccctgtctgcatctttgggagacatagtcaccatgacttgccaggcaagtcagggcactagcattaatttaaactggtttcagcaaaaaccagggaaggctcctaagctcctgatctatggttcaagcaacttggaagatggggtcccatcaaggttcagtggcagtagatatgggacagatttcactctcaccatcagcagcctggaggatgaagatctggcaacttatttctgtctacaacatagttatctcccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 11 - protein, 443 aa, Mus musculus
EVQLQQSGPELVTPGASVKISCKASGYTFTDHYMSWVKQSHGKSLEWIGDINPYSGETTYNQKFKGTATLTVDKSSSIAYMEIRGLTSEDSAVYYCARDDYDASPFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSPAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 12 - DNA, 1332 bp, Mus musculus
gaggtccagctgcaacagtctggacctgaactggtgacgcctggggcttcagtgaagatatcttgtaaggcttctggatacacattcactgaccactacatgagctgggtgaagcagagtcatggaaaaagccttgagtggattggagatattaatccctattctggtgaaactacctacaaccagaagttcaagggcacggccacattgactgtagacaagtcttccagtatagcctacatggagatccgcggcctgacatctgaggactctgcagtctattactgtgcaagagatgattacgacgcctctccgtttgcttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtccagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 13 - protein, 462 aa, Mus musculus
MRCRWIFLFLLSGTAGVLSEVQLQQSGPELVTPGASVKISCKASGYTFTDHYMSWVKQSHGKSLEWIGDINPYSGETTYNQKFKGTATLTVDKSSSIAYMEIRGLTSEDSAVYYCARDDYDASPFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSPAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 14 - DNA, 1389 bp, Mus musculus
atgagatgcaggtggatctttctctttctcctgtcaggaactgcaggtgtcctctctgaggtccagctgcaacagtctggacctgaactggtgacgcctggggcttcagtgaagatatcttgtaaggcttctggatacacattcactgaccactacatgagctgggtgaagcagagtcatggaaaaagccttgagtggattggagatattaatccctattctggtgaaactacctacaaccagaagttcaagggcacggccacattgactgtagacaagtcttccagtatagcctacatggagatccgcggcctgacatctgaggactctgcagtctattactgtgcaagagatgattacgacgcctctccgtttgcttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtccagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 15 - protein, 218 aa, Mus musculus
DIVLTQSPASLTVSLGLRATISCKASQSVDYDGDSYMNWYQQKPGQPPKLLIYAASNLESGIPARFSGNGSGTDFTLNIHPVEEEDAVTYYCQQSNEDPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 16 - DNA, 657 bp, Mus musculus
gacattgtgctgacccaatctccagcttctttgactgtgtctctaggcctgagggccaccatctcctgcaaggccagccaaagtgttgattatgatggtgatagttatatgaactggtaccagcagaaaccaggacagccacccaaactcctcatctatgctgcatccaatctagaatctgggatcccagccaggtttagtggcaatgggtctgggacagacttcaccctcaacatccatcctgtggaggaggaggatgctgtaacctattactgtcaacaaagtaatgaggatccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 17 - protein, 238 aa, Mus musculus
METDTILLWVLLLWVPGSTGDIVLTQSPASLTVSLGLRATISCKASQSVDYDGDSYMNWYQQKPGQPPKLLIYAASNLESGIPARFSGNGSGTDFTLNIHPVEEEDAVTYYCQQSNEDPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 18 - DNA, 717 bp, Mus musculus
atggagacagacacaatcctgctatgggtgctgctgctctgggttccaggctccactggtgacattgtgctgacccaatctccagcttctttgactgtgtctctaggcctgagggccaccatctcctgcaaggccagccaaagtgttgattatgatggtgatagttatatgaactggtaccagcagaaaccaggacagccacccaaactcctcatctatgctgcatccaatctagaatctgggatcccagccaggtttagtggcaatgggtctgggacagacttcaccctcaacatccatcctgtggaggaggaggatgctgtaacctattactgtcaacaaagtaatgaggatccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 19 - protein, 449 aa, Mus musculus
EVQLQQSGPELVKPGTSVKMSCKASGYTFTDCYMNWVKQSHGKSLEWIGDINPFNGGTTYNQKFKGKATLTVDKSSSTAYMQLNSLTSDDSAVYYCARSHYYFDGRVPWDAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 20 - DNA, 1350 bp, Mus musculus
gaggtccagctgcaacaatctggacctgagctggtgaagcctgggacttcagtgaagatgtcctgtaaggcttctggatacacattcactgactgctacatgaactgggtgaagcagagccatgggaagagccttgaatggattggagatattaatcctttcaacggtggtactacctacaaccagaagttcaagggcaaggccacattgactgtagacaaatcctccagcacagcctacatgcagctcaacagcctgacatctgacgactctgcagtctattactgtgcaagatcccattattacttcgatggtagagtcccttgggatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 21 - protein, 468 aa, Mus musculus
MGWNWIFLFLLSGTAGVYSEVQLQQSGPELVKPGTSVKMSCKASGYTFTDCYMNWVKQSHGKSLEWIGDINPFNGGTTYNQKFKGKATLTVDKSSSTAYMQLNSLTSDDSAVYYCARSHYYFDGRVPWDAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 22 - DNA, 1407 bp, Mus musculus
atgggatggaactggatctttctcttcctcttgtcaggaactgcaggtgtctactctgaggtccagctgcaacaatctggacctgagctggtgaagcctgggacttcagtgaagatgtcctgtaaggcttctggatacacattcactgactgctacatgaactgggtgaagcagagccatgggaagagccttgaatggattggagatattaatcctttcaacggtggtactacctacaaccagaagttcaagggcaaggccacattgactgtagacaaatcctccagcacagcctacatgcagctcaacagcctgacatctgacgactctgcagtctattactgtgcaagatcccattattacttcgatggtagagtcccttgggatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 23 - protein, 217 aa, Artificial Sequence
  Synthetic Polypeptide
  MISC_FEATURE: Rabbit-mouse chimera
AQVLTQTPASVSAAVGGTVTINCQSSQSVYDNNWLAWFQQKPGQPPKLLIYDASDLASGVPSRFSGSGSGTQFTLTISGVQCADAATYYCQGAYNDVIYAFGGGTEVVVKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 24 - DNA, 654 bp, Artificial Sequence
  Synthetic Polynucleotide
  misc_feature: Rabbit-mouse chimera
gcgcaagtgctgacccagactccagcctccgtgtctgcagctgtgggaggcacagtcaccatcaattgccagtccagtcagagtgtttatgataacaactggttagcctggtttcagcagaaaccagggcagcctcccaagctcctgatttatgatgcatccgatctggcatctggggtcccatcgcggttcagtggcagtggatctgggacacagttcactctcaccatcagcggcgtgcagtgtgccgatgctgccacttactactgtcaaggcgcttataatgatgttatttatgctttcggcggagggaccgaggtggtggtcaaacgtacggatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 25 - protein, 239 aa, Artificial Sequence
  Synthetic Polypeptide
  MISC_FEATURE: Rabbit-mouse chimera
MDTRAPTQLLGLLLLWLPGATFAQVLTQTPASVSAAVGGTVTINCQSSQSVYDNNWLAWFQQKPGQPPKLLIYDASDLASGVPSRFSGSGSGTQFTLTISGVQCADAATYYCQGAYNDVIYAFGGGTEVVVKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 26 - DNA, 720 bp, Artificial Sequence
  Synthetic Polynucleotide
  misc_feature: Rabbit-mouse chimera
atggacacgagggcccccactcagctgctggggctcctgctgctctggctcccaggtgccacatttgcgcaagtgctgacccagactccagcctccgtgtctgcagctgtgggaggcacagtcaccatcaattgccagtccagtcagagtgtttatgataacaactggttagcctggtttcagcagaaaccagggcagcctcccaagctcctgatttatgatgcatccgatctggcatctggggtcccatcgcggttcagtggcagtggatctgggacacagttcactctcaccatcagcggcgtgcagtgtgccgatgctgccacttactactgtcaaggcgcttataatgatgttatttatgctttcggcggagggaccgaggtggtggtcaaacgtacggatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 27 - protein, 433 aa, Artificial Sequence
  Synthetic Polypeptide
  MISC_FEATURE: Humanized Antibody
QSLEESGGRLVTPGTPLTLTCTASGFSLSSYWMNWVRQAPGEGLEWIGTIDSGGRTDYASWAKGRFTISRTSTTMDLKMTSLTTGDTARYFCARNWNLWGQGTLVTVSSASTKGPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 28 - DNA, 1302 bp, Artificial Sequence
  Synthetic Polynucleotide
  misc_feature: Humanized Antibody
cagtcgctggaggagtccgggggtcgcctggtcacgcctgggacacccctgacactcacctgcacagcctctggattctccctcagtagttattggatgaactgggtccgccaggctccaggggaggggctggaatggatcggaaccattgattctggtggtaggacggactacgcgagctgggcaaaaggccgattcaccatctccagaacctcgactacgatggatctgaaaatgaccagtctgacgaccggggacacggcccgttatttctgtgccagaaattggaacttgtggggccaaggcaccctcgtcaccgtctcgagcgcttctacaaagggcccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 29 - protein, 452 aa, Artificial Sequence
  Synthetic Polypeptide
  MISC_FEATURE: Humanized Antibody
METGLRWLLLVAVLKGVHCQSLEESGGRLVTPGTPLTLTCTASGFSLSSYWMNWVRQAPGEGLEWIGTIDSGGRTDYASWAKGRFTISRTSTTMDLKMTSLTTGDTARYFCARNWNLWGQGTLVTVSSASTKGPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 30 - DNA, 1359 bp, Artificial Sequence
  Synthetic Polynucleotide
  misc_feature: Humanized Antibody
atggagactgggctgcgctggcttctcctggtcgctgtgctcaaaggtgtccactgtcagtcgctggaggagtccgggggtcgcctggtcacgcctgggacacccctgacactcacctgcacagcctctggattctccctcagtagttattggatgaactgggtccgccaggctccaggggaggggctggaatggatcggaaccattgattctggtggtaggacggactacgcgagctgggcaaaaggccgattcaccatctccagaacctcgactacgatggatctgaaaatgaccagtctgacgaccggggacacggcccgttatttctgtgccagaaattggaacttgtggggccaaggcaccctcgtcaccgtctcgagcgcttctacaaagggcccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 31 - protein, 213 aa, Mus musculus
QIVLTQSPTIVSASPGEKVTLICSASSSVSFVDWFQQKPGTSPKRWIYRTSNLGFGVPARFSGGGSGTSHSLTISRMEAEDAATYYCQQRSTYPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 32 - DNA, 642 bp, Mus musculus
caaattgttctcacccagtctccaacaatcgtgtctgcatctccaggggagaaggtcaccctaatctgcagtgccagttcaagtgtaagtttcgtggactggttccagcagaagccaggcacttctcccaaacgctggatttacagaacatccaacctgggttttggagtccctgctcgcttcagtggcggtggatctgggacctctcactctctcacaatcagccgaatggaggctgaagatgctgccacttattactgccagcaaaggagtacttacccacccacgttcggtgctgggaccaagctggaactgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 33 - protein, 235 aa, Mus musculus
MHFQVQIFSFLLISASVIVSRGQIVLTQSPTIVSASPGEKVTLICSASSSVSFVDWFQQKPGTSPKRWIYRTSNLGFGVPARFSGGGSGTSHSLTISRMEAEDAATYYCQQRSTYPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 34 - DNA, 708 bp, Mus musculus
atgcattttcaagtgcagattttcagcttcctgctaatcagtgcctcagtcatagtgtccagagggcaaattgttctcacccagtctccaacaatcgtgtctgcatctccaggggagaaggtcaccctaatctgcagtgccagttcaagtgtaagtttcgtggactggttccagcagaagccaggcacttctcccaaacgctggatttacagaacatccaacctgggttttggagtccctgctcgcttcagtggcggtggatctgggacctctcactctctcacaatcagccgaatggaggctgaagatgctgccacttattactgccagcaaaggagtacttacccacccacgttcggtgctgggaccaagctggaactgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 35 - protein, 449 aa, Mus musculus
QVTLKESGPGILQPSQTLSLTCSFSGFSLSTSGMGVGWIRHPSGKNLEWLAHIWWDDVKRYNPVLKSRLTISKDTSNSQVFLKIANVDTADTATYYCARIEDFDYDEEYYAMDYWGQGTSVIVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 36 - DNA, 1350 bp, Mus musculus
caggttactctgaaagagtctggccctgggatattgcagccctcccagaccctcagtctgacttgttctttctctgggttttcactgagcacttctggtatgggtgtaggctggattcgtcacccatcagggaagaatctggagtggctggcacacatttggtgggatgatgtcaagcgctataacccagtcctgaagagccgactgactatctccaaggatacctccaacagccaggtattcctcaagatcgccaatgtggacactgcagatactgccacatactactgtgctcgaatagaggactttgattacgacgaggagtattatgctatggactactggggtcaaggaacctcagtcatcgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 37 - protein, 468 aa, Mus musculus
MGRLTSSFLLLIVPAYVLSQVTLKESGPGILQPSQTLSLTCSFSGFSLSTSGMGVGWIRHPSGKNLEWLAHIWWDDVKRYNPVLKSRLTISKDTSNSQVFLKIANVDTADTATYYCARIEDFDYDEEYYAMDYWGQGTSVIVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 38 - DNA, 1407 bp, Mus musculus
atgggcaggcttacttcttcattcctgctactgattgtccctgcatatgtcctgtcccaggttactctgaaagagtctggccctgggatattgcagccctcccagaccctcagtctgacttgttctttctctgggttttcactgagcacttctggtatgggtgtaggctggattcgtcacccatcagggaagaatctggagtggctggcacacatttggtgggatgatgtcaagcgctataacccagtcctgaagagccgactgactatctccaaggatacctccaacagccaggtattcctcaagatcgccaatgtggacactgcagatactgccacatactactgtgctcgaatagaggactttgattacgacgaggagtattatgctatggactactggggtcaaggaacctcagtcatcgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 39 - protein, 5 aa, Mus musculus
DHYMS

SEQ ID NO: 40 - protein, 17 aa, Mus musculus
DINPYSGETTYNQKFKG

SEQ ID NO: 41 - protein, 10 aa, Mus musculus
DDYDASPFAY

SEQ ID NO: 42 - protein, 11 aa, Mus musculus
QASQGTSINLN

SEQ ID NO: 43 - protein, 7 aa, Mus musculus
GSSNLED

SEQ ID NO: 44 - protein, 9 aa, Mus musculus
LQHSYLPYT

SEQ ID NO: 45 - protein, 5 aa, Mus musculus
DCYMN

SEQ ID NO: 46 - protein, 17 aa, Mus musculus
DINPFNGGTTYNQKFKG

SEQ ID NO: 47 - protein, 16 aa, Mus musculus
SHYYFDGRVPWDAMDY

SEQ ID NO: 48 - protein, 15 aa, Mus musculus
KASQSVDYDGDSYMN

SEQ ID NO: 49 - protein, 7 aa, Mus musculus
AASNLES

SEQ ID NO: 50 - protein, 9 aa, Mus musculus
QQSNEDPWT

SEQ ID NO: 51 - protein, 5 aa, Artificial Sequence
  Synthetic Polypeptide
  MISC_FEATURE: Rabbit-mouse chimera
SYWMN

SEQ ID NO: 52 - protein, 16 aa, Artificial Sequence
  Synthetic Polypeptide
  MISC_FEATURE: Rabbit-mouse chimera
TIDSGGRTDYASWAKG

SEQ ID NO: 53 - protein, 4 aa, Artificial Sequence
  Synthetic Polypeptide
  MISC_FEATURE: Rabbit-Mouse Chimera
NWNL

SEQ ID NO: 54 - protein, 13 aa, Artificial Sequence
  Synthetic Polypeptide
  MISC_FEATURE: Rabbit-mouse chimera
QSSQSVYDNNWLA

SEQ ID NO: 55 - protein, 7 aa, Artificial Sequence
  Synthetic Polypeptide
  MISC_FEATURE: Rabbit-mouse chimera
DASDLAS

SEQ ID NO: 56 - protein, 10 aa, Artificial Sequence
  Synthetic Polypeptide
  MISC_FEATURE: Rabbit-mouse chimera
QGAYNDVIYA

SEQ ID NO: 57 - protein, 7 aa, Mus musculus
TSGMGVG

SEQ ID NO: 58 - protein, 16 aa, Mus musculus
HIWWDDVKRYNPVLKS

SEQ ID NO: 59 - protein, 14 aa, Mus musculus
EDFDYDEEYYAMDY

SEQ ID NO: 60 - protein, 10 aa, Mus musculus
SASSSVSFVD

SEQ ID NO: 61 - protein, 7 aa, Mus musculus
RTSNLGF

SEQ ID NO: 62 - protein, 9 aa, Mus musculus
QQRSTYPPT

SEQ ID NO: 63 - protein, 20 aa, Homo sapiens
CGPARLLPNAIGRGKWWRPS

SEQ ID NO: 64 - protein, 20 aa, Homo sapiens
GPARLLPNAIGRGKWWRPSG

SEQ ID NO: 65 - protein, 20 aa, Homo sapiens
PARLLPNAIGRGKWWRPSGP

SEQ ID NO: 66 - protein, 20 aa, Homo sapiens
ARLLPNAIGRGKWWRPSGPD

SEQ ID NO: 67 - protein, 20 aa, Homo sapiens
RLLPNAIGRGKWWRPSGPDF

SEQ ID NO: 68 - protein, 20 aa, Homo sapiens
LLPNAIGRGKWWRPSGPDFR

SEQ ID NO: 69 - protein, 20 aa, Homo sapiens
LPNAIGRGKWWRPSGPDFRC

SEQ ID NO: 70 - protein, 14 aa, Homo sapiens
SAKPVTELVCSGQC

SEQ ID NO: 71 - protein, 7 aa, Homo sapiens
LVASCKC

SEQ ID NO: 72 - protein, 8 aa, Homo sapiens
CRELHFTR

SEQ ID NO: 73 - protein, 7 aa, Homo sapiens
CIPDRYR

SEQ ID NO: 74 - DNA, 399 bp, Artificial Sequence
  Synthetic Polynucleotide
  misc_feature: Humanized Antibody Sequence
atggacacgagggcccccactcagctgctggggctcctgctgctctggctcccaggtgccacatttgctcaagttctgacccagagtccaagcagtctctccgccagcgtaggcgatcgtgtgactattacctgtcaatctagtcagagcgtgtatgataacaattggctggcgtggtaccagcaaaaaccgggcaaagccccgaagctgctcatctatgacgcgtccgatctggctagcggtgtgccaagccgtttcagtggcagtggcagcggtactgactttaccctcacaatttcgtctctccagccggaagatttcgccacttactattgtcaaggtgcttacaacgatgtgatttatgccttcggtcagggcactaaagtagaaatcaaacgt

SEQ ID NO: 75 - protein, 133 aa, Artificial Sequence
  Synthetic Polypeptide
  MISC_FEATURE: Humanized Antibody Sequence
MDTRAPTQLLGLLLLWLPGATFAQVLTQSPSSLSASVGDRVTITCQSSQSVYDNNWLAWYQQKPGKAPKLLIYDASDLASGVPSRFSGSGSGTDFTLTISSLQPEDFATYYCQGAYNDVIYAFGQGTKVEIKR

SEQ ID NO: 76 - DNA, 393 bp, Artificial Sequence
  Synthetic Polynucleotide
  misc_feature: Humanized Antibody Sequence
atggagactgggctgcgctggcttctcctggtcgctgtgctcaaaggtgtccactgtgaggtgcagctgttggagtctggaggcgggcttgtccagcctggagggagcctgcgtctctcttgtgcagcaagcggcttcagcttatcctcttactggatgaattgggtgcggcaggcacctgggaagggcctggagtgggtgggcaccattgattccggaggccgtacagactacgcgtcttgggcaaagggccgtttcaccatttcccgcgacaactccaaaaataccatgtacctccagatgaactctctccgcgcagaggacacagcacgttattactgtgcacgcaactggaatctgtggggtcaaggtactcttgtaacagtctcgagc

SEQ ID NO: 77 - protein, 131 aa, Artificial Sequence
  Synthetic Polypeptide
  MISC_FEATURE: Humanized Antibody Sequence
METGLRWLLLVAVLKGVHCEVQLLESGGGLVQPGGSLRLSCAASGFSLSSYWMNWVRQAPGKGLEWVGTIDSGGRTDYASWAKGRFTISRDNSKNTMYLQMNSLRAEDTARYYCARNWNLWGQGTLVTVSS

SEQ ID NO: 78 - protein, 11 aa, Mus musculus
RASQDISNYLN

SEQ ID NO: 79 - protein, 7 aa, Mus musculus
YTSRLLS

SEQ ID NO: 80 - protein, 9 aa, Mus musculus
QQGDTLPYT

SEQ ID NO: 81 - protein, 11 aa, Mus musculus
RASQDISNYLN

SEQ ID NO: 82 - protein, 24 aa, Rattus norvegicus
QGWQAFKNDATEIIPGLREYPEPP

SEQ ID NO: 83 - protein, 20 aa, Rattus norvegicus
TEIIPGLREYPEPPQELENN

SEQ ID NO: 84 - protein, 20 aa, Rattus norvegicus
PEPPQELENNQTMNRAENGG

SEQ ID NO: 85 - protein, 20 aa, Rattus norvegicus
ENGGRPPHHPYDTKDVSEYS

SEQ ID NO: 86 - protein, 14 aa, Rattus norvegicus
CRELHYTRFVTDGP

SEQ ID NO: 87 - protein, 25 aa, Rattus norvegicus
CRELHYTRFVTDGPSRSAKPVTELV

SEQ ID NO: 88 - protein, 23 aa, Rattus norvegicus
CRSAKPVTELVSSGQSGPRARLL

SEQ ID NO: 89 - protein, 25 aa, Rattus norvegicus
CGPARLLPNAIGRVKWWRPNGPDFR

SEQ ID NO: 90 - protein, 20 aa, Rattus norvegicus
RAQRVQLLCPGGAAPRSRKV

SEQ ID NO: 91 - protein, 16 aa, Rattus norvegicus
PGGAAPRSRKVRLVAS

SEQ ID NO: 92 - protein, 23 aa, Rattus norvegicus
KRLTRFHNQSELKDFGPETARPQ

SEQ ID NO: 93 - protein, 16 aa, Rattus norvegicus
IPDRYAQRVQLLSPGG

SEQ ID NO: 94 - protein, 24 aa, Rattus norvegicus
SELKDFGPETARPQKGRKPRPRAR

SEQ ID NO: 95 - protein, 23 aa, Rattus norvegicus
KGRKPRPRARGAKANQAELENAY

SEQ ID NO: 96 - protein, 18 aa, Rattus norvegicus
PNAIGRVKWWRPNGPDFR

SEQ ID NO: 97 - protein, 22 aa, Rattus norvegicus
KWWRPNGPDFRCIPDRYRAQRV

SEQ ID NO: 98 - protein, 213 aa, Rattus norvegicus
MQLSLAPCLACLLVHAAFVAVESQGWQAFKNDATEIIPGLREYPEPPQELENNQTMNRAENGGRPPHHPYDTKDVSEYSCRELHYTRFVTDGPCRSAKPVTELVCSGQCGPARLLPNAIGRVKWWRPNGPDFRCIPDRYRAQRVQLLCPGGAAPRSRKVRLVASCKCKRLTRFHNQSELKDFGPETARPQKGRKPRPRARGAKANQAELENAY

SEQ ID NO: 99 - protein, 7 aa, Mus musculus
YTSRLHS

SEQ ID NO: 100 - protein, 9 aa, Mus musculus
QQGDTLPYT

SEQ ID NO: 101 - protein, 11 aa, Mus musculus
RASQVITNYLY

SEQ ID NO: 102 - protein, 7 aa, Mus musculus
YTSRLHS

SEQ ID NO: 103 - protein, 9 aa, Mus musculus
QQGDTLPYT

SEQ ID NO: 104 - protein, 11 aa, Mus musculus
RASQDISNYLN

SEQ ID NO: 105 - protein, 7 aa, Mus musculus
YTSRLLS

SEQ ID NO: 106 - protein, 9 aa, Mus musculus
QQGDTLPYT

SEQ ID NO: 107 - protein, 11 aa, Mus musculus
RASQDISNYLN

SEQ ID NO: 108 - protein, 7 aa, Mus musculus
YTSRLFS

SEQ ID NO: 109 - protein, 9 aa, Mus musculus
QQGDTLPYT

SEQ ID NO: 110 - protein, 11 aa, Mus musculus
RASQDISNYLN

SEQ ID NO: 111 - protein, 7 aa, Mus musculus
YTSRLLS

SEQ ID NO: 112 - protein, 9 aa, Mus musculus
QQGDTLPYT

SEQ ID NO: 113 - protein, 11 aa, Mus musculus
RASQDISNYLN

SEQ ID NO: 114 - protein, 7 aa, Mus musculus
YTSTLQS

SEQ ID NO: 115 - protein, 9 aa, Mus musculus
QQGDTLPYT

SEQ ID NO: 116 - protein, 12 aa, Mus musculus
SVSSSISSSNLH

SEQ ID NO: 117 - protein, 213 aa, Mus musculus
QIVLSQSPAILSTSPGEKVTMTCRASSSVYYMHWYQQKPGSSPKPWIYATSNLASGVPVRFSGSGSGTSYSLTITRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 118 - DNA, 642 bp, Mus musculus
caaattgttctctcccagtctccagcaatcctgtctacatctccaggggagaaggtcacaatgacttgcagggccagctcaagtgtatattacatgcactggtaccagcagaagccaggatcctcccccaaaccctggatttatgccacatccaacctggcttctggagtccctgttcgcttcagtggcagtgggtctgggacctcttactctctcacaatcaccagagtggaggctgaagatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 119 - protein, 235 aa, Mus musculus
MDFQVQIFSFLLISASVIMSRGQIVLSQSPAILSTSPGEKVTMTCRASSSVYYMHWYQQKPGSSPKPWIYATSNLASGVPVRFSGSGSGTSYSLTITRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 120 - DNA, 708 bp, Mus musculus
atggattttcaagtgcagattttcagcttcctgctaatcagtgcttcagtcattatgtccaggggacaaattgttctctcccagtctccagcaatcctgtctacatctccaggggagaaggtcacaatgacttgcagggccagctcaagtgtatattacatgcactggtaccagcagaagccaggatcctcccccaaaccctggatttatgccacatccaacctggcttctggagtccctgttcgcttcagtggcagtgggtctgggacctcttactctctcacaatcaccagagtggaggctgaagatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 121 - protein, 445 aa, Mus musculus
EVQVQQSGPELVKPGASVKLSCTASGFNIKDYFIHWVKQRPEQGLEWIGRLDPEDGESDYAPKFQDKAIMTADTSSNTAYLQLRSLTSEDTAIYYCEREDYDGTYTFFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 122 - DNA, 1338 bp, Mus musculus
gaggttcaggtgcagcagtctgggccagaacttgtgaagccaggggcctcagtcaagttgtcctgcacagcttctggcttcaacattaaagactactttatacactgggtgaagcagaggcctgaacagggcctggagtggattggaaggcttgatcctgaggatggtgaaagtgattatgccccgaagttccaggacaaggccattatgacagcagacacatcatccaacacagcctatcttcagctcagaagcctgacatctgaggacactgccatctattattgtgagagagaggactacgatggtacctacaccttttttccttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 123 - protein, 464 aa, Mus musculus
MKCSWVIFFLMAVVTGVNSEVQVQQSGPELVKPGASVKLSCTASGFNIKDYFIHWVKQRPEQGLEWIGRLDPEDGESDYAPKFQDKAIMTADTSSNTAYLQLRSLTSEDTAIYYCEREDYDGTYTFFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 124 - DNA, 1395 bp, Mus musculus
atgaaatgcagctgggtcatcttcttcctgatggcagtggttacaggggtcaattcagaggttcaggtgcagcagtctgggccagaacttgtgaagccaggggcctcagtcaagttgtcctgcacagcttctggcttcaacattaaagactactttatacactgggtgaagcagaggcctgaacagggcctggagtggattggaaggcttgatcctgaggatggtgaaagtgattatgccccgaagttccaggacaaggccattatgacagcagacacatcatccaacacagcctatcttcagctcagaagcctgacatctgaggacactgccatctattattgtgagagagaggactacgatggtacctacaccttttttccttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 125 - protein, 215 aa, Mus musculus
EIVLTQSPALMAASPGEKVTITCSVSSTISSNHLHWFQQKSDTSPKPWIYGTSNLASGVPVRFSGSGSGTSYSLTISSMEAEDAATYYCQQWSSYPLTFGAGTKLELRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 126 - DNA, 648 bp, Mus musculus
gaaattgtgctcacccagtctccagcactcatggctgcatctccgggggagaaggtcaccatcacctgcagtgtcagttcaactataagttccaaccacttgcactggttccagcagaagtcagacacctcccccaaaccctggatttatggcacatccaacctggcttctggagtccctgttcgcttcagtggcagtggatctgggacctcttattctctcacaatcagcagcatggaggctgaggatgctgccacttattactgtcaacagtggagtagttacccactcacgttcggcgctgggaccaagctggagctgagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 127 - protein, 237 aa, Mus musculus
MDFHVQIFSFMLISVTVILSSGEIVLTQSPALMAASPGEKVTITCSVSSTISSNHLHWFQQKSDTSPKPWIYGTSNLASGVPVRFSGSGSGTSYSLTISSMEAEDAATYYCQQWSSYPLTFGAGTKLELRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 128 - DNA, 714 bp, Mus musculus
atggattttcatgtgcagattttcagcttcatgctaatcagtgtcacagtcattttgtccagtggagaaattgtgctcacccagtctccagcactcatggctgcatctccgggggagaaggtcaccatcacctgcagtgtcagttcaactataagttccaaccacttgcactggttccagcagaagtcagacacctcccccaaaccctggatttatggcacatccaacctggcttctggagtccctgttcgcttcagtggcagtggatctgggacctcttattctctcacaatcagcagcatggaggctgaggatgctgccacttattactgtcaacagtggagtagttacccactcacgttcggcgctgggaccaagctggagctgagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 129 - protein, 449 aa, Mus musculus
EVQLQQSGAELVRPGALVKLSCTASDFNIKDFYLHWMRQRPEQGLDWIGRIDPENGDTLYDPKFQDKATLTTDTSSNTAYLQLSGLTSETTAVYYCSREADYFHDGTSYWYFDVWGAGTTITVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 130 - DNA, 1350 bp, Mus musculus
gaggttcagctgcagcagtctggggctgaacttgtgaggccaggggccttagtcaagttgtcctgcacagcttctgacttcaacattaaagacttctatctacactggatgaggcagcggcctgaacagggcctggactggattggaaggattgatcctgagaatggtgatactttatatgacccgaagttccaggacaaggccactcttacaacagacacatcctccaacacagcctacctgcagctcagcggcctgacatctgagaccactgccgtctattactgttctagagaggcggattatttccacgatggtacctcctactggtacttcgatgtctggggcgcagggaccacaatcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 131 - protein, 468 aa, Mus musculus
MKCSWVIFFLMAVVTGVNSEVQLQQSGAELVRPGALVKLSCTASDFNIKDFYLHWMRQRPEQGLDWIGRIDPENGDTLYDPKFQDKATLTTDTSSNTAYLQLSGLTSETTAVYYCSREADYFHDGTSYWYFDVWGAGTTITVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 132 - DNA, 1407 bp, Mus musculus
atgaaatgcagctgggtcatcttcttcctgatggcagtggttacaggggtcaattcagaggttcagctgcagcagtctggggctgaacttgtgaggccaggggccttagtcaagttgtcctgcacagcttctgacttcaacattaaagacttctatctacactggatgaggcagcggcctgaacagggcctggactggattggaaggattgatcctgagaatggtgatactttatatgacccgaagttccaggacaaggccactcttacaacagacacatcctccaacacagcctacctgcagctcagcggcctgacatctgagaccactgccgtctattactgttctagagaggcggattatttccacgatggtacctcctactggtacttcgatgtctggggcgcagggaccacaatcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 133 - protein, 214 aa, Mus musculus
DIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 134 - DNA, 645 bp, Mus musculus
gatatccagatgacacagattacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 135 - protein, 234 aa, Mus musculus
MMSSAQFLGLLLLCFQGTRCDIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 136 - DNA, 705 bp, Mus musculus
atgatgtcctctgctcagttccttggtctcctgttgctctgttttcaaggtaccagatgtgatatccagatgacacagattacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 137 - protein, 447 aa, Mus musculus
EVQLQQSGPELMKPGASVKMSCKASGYTFTDYNMHWVKQNQGKTLEWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 138 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 139 - protein, 466 aa, Mus musculus
MGWSWTFLFLLSGTAGVLSEVQLQQSGPELMKPGASVKMSCKASGYTFTDYNMHWVKQNQGKTLEWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 140 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 141 - protein, 214 aa, Artificial Sequence
  Synthetic Polypeptide
  MISC_FEATURE: Humanized Antibody Sequence
DIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - DNA, 642 bp, Artificial Sequence
  Synthetic Polynucleotide
  misc_feature: Humanized Antibody Sequence
gacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 143 - protein, 236 aa, Artificial Sequence
  Synthetic Polypeptide
  MISC_FEATURE: Humanized Antibody Sequence
MDMRVPAQLLGLLLLWLRGARCDIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 144 - DNA, 708 bp, Artificial Sequence
  Synthetic Polynucleotide
  misc_feature: Humanized Antibody Sequence
atggacatgagggtccccgctcagctcctggggctcctgctactctggctccgaggtgccagatgtgacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 145 - protein, 449 aa, Artificial Sequence
  Synthetic Polypeptide
  MISC_FEATURE: Humanized Antibody Sequence
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 146 - DNA, 1347 bp, Artificial Sequence
  Synthetic Polynucleotide
  misc_feature: Humanized Antibody Sequence
gaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 147 - protein, 468 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 148 - DNA, 1404 bp, Mus musculus
atggactggacctggaggatcctcttcttggtggcagcagccacaggagcccactccgaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 149 - protein, 214 aa, Mus musculus
DIQMTQTTSSLSASLGDRVTISCRASQDISNYLNWFQQKPDGTLKLLIFYTSRLHSGVPSRFSGSGSGTDYSLTISNLEQEDIATYFCQQGDTLPYTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 150 - DNA, 645 bp, Mus musculus
gatatccagatgacacagactacatcctccctgtctgcctctctgggagacagagtcaccatcagttgcagggcaagtcaggacattagcaattatttaaactggtttcagcagaaaccagatggaactcttaaactcctgatcttctacacatcaagattacactcaggagttccatcaaggttcagtggcagtgggtctggaacagattattctctcaccattagcaacctggagcaagaagatattgccacttacttttgccaacagggtgatacgcttccgtacacgttcgggggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 151 - protein, 234 aa, Mus musculus
MMSSAQFLGLLLLCFQGTRCDIQMTQTTSSLSASLGDRVTISCRASQDISNYLNWFQQKPDGTLKLLIFYTSRLHSGVPSRFSGSGSGTDYSLTISNLEQEDIATYFCQQGDTLPYTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 152 - DNA, 705 bp, Mus musculus
atgatgtcctctgctcagttccttggtctcctgttgctctgttttcaaggtaccagatgtgatatccagatgacacagactacatcctccctgtctgcctctctgggagacagagtcaccatcagttgcagggcaagtcaggacattagcaattatttaaactggtttcagcagaaaccagatggaactcttaaactcctgatcttctacacatcaagattacactcaggagttccatcaaggttcagtggcagtgggtctggaacagattattctctcaccattagcaacctggagcaagaagatattgccacttacttttgccaacagggtgatacgcttccgtacacgttcgggggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 153 - protein, 447 aa, Mus musculus
EVQLQQSGPELMKPGASVKMSCKASGYTFTDYNMHWVKQNQGKSLEWIGEINPNSGGSGYNQKFKGKATLTVDKSSSTAYMELRSLTSEDSAVYYCARLVYDGSYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 154 - DNA, 1344 bp, Mus musculus
gaggtccagctgcaacagtctggacctgaactaatgaagcctggggcttcagtgaagatgtcctgcaaggcttctggatacacattcactgactacaacatgcactgggtgaaacagaaccaaggaaagagcctagagtggataggagaaattaatcctaacagtggtggtagtggctacaaccaaaagttcaaaggcaaggccacattgactgtagacaagtcttccagcacagcctacatggagctccgcagcctgacatctgaggactctgcagtctattactgtgcaagattggtctacgatggcagctacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 155 - protein, 466 aa, Mus musculus
MGWSWTFLFLLSGTAGVLSEVQLQQSGPELMKPGASVKMSCKASGYTFTDYNMHWVKQNQGKSLEWIGEINPNSGGSGYNQKFKGKATLTVDKSSSTAYMELRSLTSEDSAVYYCARLVYDGSYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 156 - DNA, 1401 bp, Mus musculus
atgggatggagctggacctttctcttcctcctgtcaggaactgcaggtgtcctctctgaggtccagctgcaacagtctggacctgaactaatgaagcctggggcttcagtgaagatgtcctgcaaggcttctggatacacattcactgactacaacatgcactgggtgaaacagaaccaaggaaagagcctagagtggataggagaaattaatcctaacagtggtggtagtggctacaaccaaaagttcaaaggcaaggccacattgactgtagacaagtcttccagcacagcctacatggagctccgcagcctgacatctgaggactctgcagtctattactgtgcaagattggtctacgatggcagctacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 157 - protein, 214 aa, Mus musculus
DIQMTQTTSSLSASLGDRVTICCRASQVITNYLYWYQQKPDGTFKLLIYYTSRLHSGVPSRFSGSGSGTDYSLTISNLEQEDIATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 158 - DNA, 642 bp, Mus musculus
gatatccagatgacacagactacatcctccctgtctgcctctctgggagacagagtcaccatctgttgcagggcaagtcaggtcattaccaattatttatactggtatcagcagaaaccagatggaacttttaaactcctgatctactacacatcaagattacactcaggagtcccatcaaggttcagtggcagtgggtctggaacagattattctctcaccattagcaacctggaacaggaagatattgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 159 - protein, 234 aa, Mus musculus
MMSSAQFLGLLLLCFQGTRCDIQMTQTTSSLSASLGDRVTICCRASQVITNYLYWYQQKPDGTFKLLIYYTSRLHSGVPSRFSGSGSGTDYSLTISNLEQEDIATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 160 - DNA, 702 bp, Mus musculus
atgatgtcctctgctcagttccttggtctcctgttgctctgttttcaaggtaccagatgtgatatccagatgacacagactacatcctccctgtctgcctctctgggagacagagtcaccatctgttgcagggcaagtcaggtcattaccaattatttatactggtatcagcagaaaccagatggaacttttaaactcctgatctactacacatcaagattacactcaggagtcccatcaaggttcagtggcagtgggtctggaacagattattctctcaccattagcaacctggaacaggaagatattgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 161 - protein, 447 aa, Mus musculus
EVQLQQSGPELMKPGASVKMSCKASGYTFTDYNMHWMKQNQGKSLEWIGEINPNSGGAGYNQQFKGKATLTVDKSSRTAYMELRSLTSEDSAVYYCARLGYVGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 162 - DNA, 1341 bp, Mus musculus
gaggtccagctgcaacagtctggacctgaactaatgaagcctggggcttcagtgaagatgtcctgcaaggcttctggatacacattcactgactacaacatgcactggatgaagcagaaccaaggaaagagcctagaatggataggagaaattaatcctaacagtggtggtgctggctacaaccagcagttcaaaggcaaggccacattgactgtagacaagtcctccaggacagcctacatggagctccgcagcctgacatctgaggactctgcagtctattactgtgcaagattgggctacgttggtaattacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 163 - protein, 466 aa, Mus musculus
MGWSWTFLFLLSGTAGVLSEVQLQQSGPELMKPGASVKMSCKASGYTFTDYNMHWMKQNQGKSLEWIGEINPNSGGAGYNQQFKGKATLTVDKSSRTAYMELRSLTSEDSAVYYCARLGYVGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 164 - DNA, 1398 bp, Mus musculus
atgggatggagctggacctttctcttcctcctgtcaggaactgcaggtgtcctctctgaggtccagctgcaacagtctggacctgaactaatgaagcctggggcttcagtgaagatgtcctgcaaggcttctggatacacattcactgactacaacatgcactggatgaagcagaaccaaggaaagagcctagaatggataggagaaattaatcctaacagtggtggtgctggctacaaccagcagttcaaaggcaaggccacattgactgtagacaagtcctccaggacagcctacatggagctccgcagcctgacatctgaggactctgcagtctattactgtgcaagattgggctacgttggtaattacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 165 - protein, 214 aa, Mus musculus
DIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 166 - DNA, 645 bp, Mus musculus
gatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 167 - protein, 234 aa, Mus musculus
MMSSAQFLGLLLLCFQGTRCDIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 168 - DNA, 705 bp, Mus musculus
atgatgtcctctgctcagttccttggtctcctgttgctctgttttcaaggtaccagatgtgatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 169 - protein, 447 aa, Mus musculus
EVQLQQSGPELMKPGASVKMSCKASGYTFTDYNMHWVKQNQGKTLDWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 170 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagactggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 171 - protein, 466 aa, Mus musculus
MGWSWTFLFLLSGTAGVLSEVQLQQSGPELMKPGASVKMSCKASGYTFTDYNMHWVKQNQGKTLDWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 172 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagactggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 173 - protein, 214 aa, Mus musculus
DIQMTQITSSLSASLGDRVSISCRASQDISNYLNWYQQKPDGTFKLLIFYTSRLFSGVPSRFSGSGSGTDYSLTIYNLEQEDFATYFCQQGDTLPYTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 174 - DNA, 642 bp, Mus musculus
gatatccagatgacacagattacatcctccctgtctgcctctctgggagacagggtctccatcagttgcagggcaagtcaagacattagcaattatttaaattggtatcagcagaaaccagatggaacttttaaactccttatcttctacacatcaagattattttcaggagtcccatcaaggttcagtggcagtgggtctggaacagattattctctcaccatttacaacctggagcaagaagattttgccacttacttttgccaacagggagatacgcttccgtacactttcggaggggggaccaaggtggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 175 - protein, 234 aa, Mus musculus
MMSSAQFLGLLLLCFQGTRCDIQMTQITSSLSASLGDRVSISCRASQDISNYLNWYQQKPDGTFKLLIFYTSRLFSGVPSRFSGSGSGTDYSLTIYNLEQEDFATYFCQQGDTLPYTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 176 - DNA, 702 bp, Mus musculus
atgatgtcctctgctcagttccttggtctcctgttgctctgttttcaaggtaccagatgtgatatccagatgacacagattacatcctccctgtctgcctctctgggagacagggtctccatcagttgcagggcaagtcaagacattagcaattatttaaattggtatcagcagaaaccagatggaacttttaaactccttatcttctacacatcaagattattttcaggagtcccatcaaggttcagtggcagtgggtctggaacagattattctctcaccatttacaacctggagcaagaagattttgccacttacttttgccaacagggagatacgcttccgtacactttcggaggggggaccaaggtggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 177 - protein, 450 aa, Mus musculus
EVQLQQSGPELMKPGTSVKMSCKASGYTFTDYNMHWVKQTQGKTLEWIGEINPNSGGAGYNQKFKGKATLTVDKSSTTAYMELRSLTSEDSAVYYCAKLGYDDIYDDWYFDVWGAGTTVTVSSAKTTAPSVYPLAPVCGDTTGSSVTLGCLVKGYFPEPVTLTWNSGSLSSDVHTFPALLQSGLYTLSSSVTVTTWPSQTITCNVAHPASSTKVDKKIEPRGSPTHKPCPPCPAPNLLGGPSVFIFPPKIKDVLMISLSPMVTCVVVDVSEDDPDVHVSWFVNNVEVHTAQTQTHREDYNSTIRVVSALPIQHQDWMSGKEFKCKVNNKALPAPIERTISKPKGPVRAPQVYVLPPPEEEMTKKQVTLTCMITDFMPEDIYVEWTNNGQTELNYKNTEPVLDSDGSYFMYSKLRVEKKNWVERNSYSCSVVHEGLHNHHTTKSFSRTPGK

SEQ ID NO: 178 - DNA, 1350 bp, Mus musculus
gaggtccaactgcaacagtctggacctgaactaatgaagcctgggacttcagtgaagatgtcctgcaaggcttctggatatacattcactgactacaacatgcactgggtgaagcagacccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaaaattgggctacgatgatatctacgacgactggtatttcgatgtctggggcgcagggaccacggtcaccgtctcctcagccaaaacaacagccccatcggtctatccactggcccctgtgtgtggagatacaactggctcctcggtgactctaggatgcctggtcaagggttatttccctgagccagtgaccttgacctggaactctggatccctgtccagtgatgtgcacaccttcccagctctcctgcagtctggcctctacaccctcagcagctcagtgactgtaaccacctggcccagccagaccatcacctgcaatgtggcccacccggcaagcagcaccaaagtggacaagaaaattgagcccagagggtccccaacacataaaccctgtcctccatgcccagctcctaacctcttgggtggaccatccgtcttcatcttccctccaaagatcaaggatgtactcatgatctccctgagccccatggtcacgtgtgtggtggtggatgtgagcgaggatgacccagatgtccatgtcagctggttcgtgaacaacgtggaagtacacacagctcagacacaaacccatagagaggattacaacagtactatccgggtggtcagtgccctccccatccagcaccaggactggatgagtggcaaggagttcaaatgcaaggtcaacaacaaagccctcccagcgcccatcgagagaaccatctcaaaacccaaagggccagtaagagctccacaggtatatgtcttgcctccaccagaagaagagatgactaagaaacaggtcactctgacctgcatgatcacagacttcatgcctgaagacatttacgtggagtggaccaacaacgggcaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 179 - protein, 469 aa, Mus musculus
MGWSWTFLFLLSGTAGVLSEVQLQQSGPELMKPGTSVKMSCKASGYTFTDYNMHWVKQTQGKTLEWIGEINPNSGGAGYNQKFKGKATLTVDKSSTTAYMELRSLTSEDSAVYYCAKLGYDDIYDDWYFDVWGAGTTVTVSSAKTTAPSVYPLAPVCGDTTGSSVTLGCLVKGYFPEPVTLTWNSGSLSSDVHTFPALLQSGLYTLSSSVTVTTWPSQTITCNVAHPASSTKVDKKIEPRGSPTHKPCPPCPAPNLLGGPSVFIFPPKIKDVLMISLSPMVTCVVVDVSEDDPDVHVSWFVNNVEVHTAQTQTHREDYNSTIRVVSALPIQHQDWMSGKEFKCKVNNKALPAPIERTISKPKGPVRAPQVYVLPPPEEEMTKKQVTLTCMITDFMPEDIYVEWTNNGQTELNYKNTEPVLDSDGSYFMYSKLRVEKKNWVERNSYSCSVVHEGLHNHHTTKSFSRTPGK

SEQ ID NO: 180 - DNA, 1407 bp, Mus musculus
atgggatggagctggacctttctcttcctcctgtcaggaactgcaggtgtcctctctgaggtccaactgcaacagtctggacctgaactaatgaagcctgggacttcagtgaagatgtcctgcaaggcttctggatatacattcactgactacaacatgcactgggtgaagcagacccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaaaattgggctacgatgatatctacgacgactggtatttcgatgtctggggcgcagggaccacggtcaccgtctcctcagccaaaacaacagccccatcggtctatccactggcccctgtgtgtggagatacaactggctcctcggtgactctaggatgcctggtcaagggttatttccctgagccagtgaccttgacctggaactctggatccctgtccagtgatgtgcacaccttcccagctctcctgcagtctggcctctacaccctcagcagctcagtgactgtaaccacctggcccagccagaccatcacctgcaatgtggcccacccggcaagcagcaccaaagtggacaagaaaattgagcccagagggtccccaacacataaaccctgtcctccatgcccagctcctaacctcttgggtggaccatccgtcttcatcttccctccaaagatcaaggatgtactcatgatctccctgagccccatggtcacgtgtgtggtggtggatgtgagcgaggatgacccagatgtccatgtcagctggttcgtgaacaacgtggaagtacacacagctcagacacaaacccatagagaggattacaacagtactatccgggtggtcagtgccctccccatccagcaccaggactggatgagtggcaaggagttcaaatgcaaggtcaacaacaaagccctcccagcgcccatcgagagaaccatctcaaaacccaaagggccagtaagagctccacaggtatatgtcttgcctccaccagaagaagagatgactaagaaacaggtcactctgacctgcatgatcacagacttcatgcctgaagacatttacgtggagtggaccaacaacgggcaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 181 - protein, 214 aa, Mus musculus
DIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPLSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 182 - DNA, 645 bp, Mus musculus
gatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccactatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 183 - protein, 234 aa, Mus musculus
MMSSAQFLGLLLLCFQGTRCDIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPLSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 184 - DNA, 705 bp, Mus musculus
atgatgtcctctgctcagttccttggtctcctgttgctctgttttcaaggtaccagatgtgatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccactatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 185 - protein, 447 aa, Mus musculus; identical to SEQ ID NO: 137

SEQ ID NO: 186 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagaatggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 187 - protein, 466 aa, Mus musculus; identical to SEQ ID NO: 139

SEQ ID NO: 188 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagaatggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 189 - protein, 213 aa, Mus musculus
QIVLSQSPAFLSVSPGDKVTMTCRASSSISYIHWFQQKPGSSPRSWIYATSNLASGVPGRFSGSGSGTSYSLTISRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 190 - DNA, 642 bp, Mus musculus
caaattgttctctcccagtctccagcattcctgtctgtatctccaggggataaggtcacaatgacttgcagggccagctcaagtataagttacatacactggtttcagcagaagccaggatcctcccccagatcctggatttatgccacatccaacctggcttctggagtccctggtcgcttcagtggcagtgggtctgggacctcttactctctcacaatcagcagagtggaggctgaggatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 191 - protein, 235 aa, Mus musculus
MDFQVQIFSFLLISASVIMSRGQIVLSQSPAFLSVSPGDKVTMTCRASSSISYIHWFQQKPGSSPRSWIYATSNLASGVPGRFSGSGSGTSYSLTISRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 192 - DNA, 708 bp, Mus musculus
atggattttcaagtgcagattttcagcttcctgctaatcagtgcttcagtcataatgtccagaggacaaattgttctctcccagtctccagcattcctgtctgtatctccaggggataaggtcacaatgacttgcagggccagctcaagtataagttacatacactggtttcagcagaagccaggatcctcccccagatcctggatttatgccacatccaacctggcttctggagtccctggtcgcttcagtggcagtgggtctgggacctcttactctctcacaatcagcagagtggaggctgaggatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 193 - protein, 445 aa, Mus musculus
EVQLQQSGADLVQPGASVKVSCTASGFDIKDYYIHWMKQRPDQGLEWIGRVDPDNGETEFAPKFPGKATFTTDTSSNTAYLQLRGLTSEDTAIYYCGREDYDGTYTWFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 194 - DNA, 1338 bp, Mus musculus
gaagttcagctgcaacagtctggggcagaccttgtgcagccaggggcctcagtcaaggtgtcctgcacagcttctggcttcgacattaaggactactatatacactggatgaaacagaggcctgaccagggcctggagtggattggaagggttgatcctgacaatggtgagactgaatttgccccgaagttcccgggcaaggccacttttacaacagacacatcctccaacacagcctacctacaactcagaggcctgacatctgaggacactgccatctattactgtgggagagaagactacgatggtacctacacctggtttccttattggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 195 - protein, 464 aa, Mus musculus
MKCSWVIFFLMAVVTGVNSEVQLQQSGADLVQPGASVKVSCTASGFDIKDYYIHWMKQRPDQGLEWIGRVDPDNGETEFAPKFPGKATFTTDTSSNTAYLQLRGLTSEDTAIYYCGREDYDGTYTWFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 196 - DNA, 1395 bp, Mus musculus
atgaaatgcagctgggtcatcttcttcctgatggcagtggttacaggggtcaattcagaagttcagctgcaacagtctggggcagaccttgtgcagccaggggcctcagtcaaggtgtcctgcacagcttctggcttcgacattaaggactactatatacactggatgaaacagaggcctgaccagggcctggagtggattggaagggttgatcctgacaatggtgagactgaatttgccccgaagttcccgggcaaggccacttttacaacagacacatcctccaacacagcctacctacaactcagaggcctgacatctgaggacactgccatctattactgtgggagagaagactacgatggtacctacacctggtttccttattggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 197 - protein, 214 aa, Mus musculus
DLQMTQTTSSLSASLGDRVTISCRASQDISNYLNWYQQKPDGTVKLLIFYTSTLQSGVPSRFSGSGSGTNYSLTITNLEQDDAATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 198 - DNA, 645 bp, Mus musculus
gatctccagatgacacagactacttcctccctgtctgcctctctgggagacagagtcaccatcagttgcagggcaagtcaggacattagcaattatttaaactggtatcagcagaaaccagatggaactgttaagctcctgatcttctacacatcaacattacagtcaggagtcccatcgaggttcagtggcagtgggtctggaacaaattattctctcaccattaccaacctggagcaagatgatgctgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 199 - protein, 234 aa, Mus musculus
MMSSAQFLGLLLLCFQGSRCDLQMTQTTSSLSASLGDRVTISCRASQDISNYLNWYQQKPDGTVKLLIFYTSTLQSGVPSRFSGSGSGTNYSLTITNLEQDDAATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 200 - DNA, 705 bp, Mus musculus
atgatgtcctctgctcagttccttggtctcctgttgctctgttttcaaggttccagatgtgatctccagatgacacagactacttcctccctgtctgcctctctgggagacagagtcaccatcagttgcagggcaagtcaggacattagcaattatttaaactggtatcagcagaaaccagatggaactgttaagctcctgatcttctacacatcaacattacagtcaggagtcccatcgaggttcagtggcagtgggtctggaacaaattattctctcaccattaccaacctggagcaagatgatgctgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 201 - protein, 447 aa, Mus musculus
EVQLQQSGPELMKPGASVKMSCKASGYTFTDYNMHWMKQNQGKSLEWIGEINPNSGGSGYNQKFKGKATLTVDKSSSTAYMELRSLTSEDSAVYYCARLGYYGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 202 - DNA, 1344 bp, Mus musculus
gaggtccagttgcaacagtctggacctgaactaatgaagcctggggcttcagtgaagatgtcctgcaaggcttctggatacacattcactgactacaacatgcactggatgaagcagaaccaaggaaagagcctagagtggataggagagattaatcctaacagtggtggttctggttacaaccagaagttcaaaggcaaggccacattgactgtagacaagtcctccagcacagcctacatggagctccgcagcctgacatctgaggactctgcagtctattactgtgcaagattgggctactatggtaactacgaggactggtatttcgatgtctggggcgcagggaccacggtcaccgtctcctctgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 203 - protein, 466 aa, Mus musculus
MGWSWTFLFLLSGTSGVLSEVQLQQSGPELMKPGASVKMSCKASGYTFTDYNMHWMKQNQGKSLEWIGEINPNSGGSGYNQKFKGKATLTVDKSSSTAYMELRSLTSEDSAVYYCARLGYYGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 204 - DNA, 1401 bp, Mus musculus
atgggatggagctggacctttctcttcctcctgtcaggaacttcgggtgtcctctctgaggtccagttgcaacagtctggacctgaactaatgaagcctggggcttcagtgaagatgtcctgcaaggcttctggatacacattcactgactacaacatgcactggatgaagcagaaccaaggaaagagcctagagtggataggagagattaatcctaacagtggtggttctggttacaaccagaagttcaaaggcaaggccacattgactgtagacaagtcctccagcacagcctacatggagctccgcagcctgacatctgaggactctgcagtctattactgtgcaagattgggctactatggtaactacgaggactggtatttcgatgtctggggcgcagggaccacggtcaccgtctcctctgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 205 - protein, 215 aa, Mus musculus
QIVLTQSPAIMSASPGEKVTMTCRASSSVTSSYLNWYQQKPGSSPKLWIYSTSNLASGVPARFSGSGSGTSYSLTISSVEAEDAATYYCQQYDFFPSTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 206 - DNA, 645 bp, Mus musculus
cagattgttctcacccagtctccagcaatcatgtctgcatctccaggggagaaggtcaccatgacctgcagggccagctcaagtgtaacttccagttacttgaactggtaccagcagaagccaggatcttcccccaaactctggatttatagcacatccaacctggcttcaggagtcccagctcgcttcagtggcagtgggtctgggacctcttactctctcacaatcagcagtgtggaggctgaggatgctgccacttattactgccagcagtatgattttttcccatcgacgttcggtggaggcaccaagctggaaatcaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccatcgtcaagagcttcaacaggaatgagtgt

SEQ ID NO: 207 - protein, 237 aa, Mus musculus
MDSQVQIFSFLLISALVKMSRGQIVLTQSPAIMSASPGEKVTMTCRASSSVTSSYLNWYQQKPGSSPKLWIYSTSNLASGVPARFSGSGSGTSYSLTISSVEAEDAATYYCQQYDFFPSTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 208 - DNA, 711 bp, Mus musculus
atggattctcaagtgcagattttcagcttccttctaatcagtgccttagtcaaaatgtccagaggacagattgttctcacccagtctccagcaatcatgtctgcatctccaggggagaaggtcaccatgacctgcagggccagctcaagtgtaacttccagttacttgaactggtaccagcagaagccaggatcttcccccaaactctggatttatagcacatccaacctggcttcaggagtcccagctcgcttcagtggcagtgggtctgggacctcttactctctcacaatcagcagtgtggaggctgaggatgctgccacttattactgccagcagtatgattttttcccatcgacgttcggtggaggcaccaagctggaaatcaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccatcgtcaagagcttcaacaggaatgagtgt

SEQ ID NO: 209 - protein, 445 aa, Mus musculus
EVQLQQSGPELVKPGASVKMSCKASGYTFTDYYMNWVKQSHGESLEWIGDINPYNDDTTYNHKFKGKATLTVDKSSNTAYMQLNSLTSEDSAVYYCARETAVITTNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 210 - DNA, 1335 bp, Mus musculus
gaggtccagctgcaacaatctggacctgagctggtgaagcctggggcttcagtgaagatgtcctgtaaggcttctggatacacattcactgactactacatgaactgggtgaagcagagccatggagagagccttgagtggattggagatattaatccttacaacgatgatactacctacaaccacaagttcaagggcaaggccacattgactgtagacaaatcctccaacacagcctacatgcagctcaacagcctgacatctgaggactctgcagtctattactgtgcaagagagacggccgttattactacgaatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 211 - protein, 464 aa, Mus musculus
MGWNWIFLFLLSGTAGVYSEVQLQQSGPELVKPGASVKMSCKASGYTFTDYYMNWVKQSHGESLEWIGDINPYNDDTTYNHKFKGKATLTVDKSSNTAYMQLNSLTSEDSAVYYCARETAVITTNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 212 - DNA, 1392 bp, Mus musculus
atgggatggaactggatctttctcttcctcttgtcaggaactgcaggtgtctactctgaggtccagctgcaacaatctggacctgagctggtgaagcctggggcttcagtgaagatgtcctgtaaggcttctggatacacattcactgactactacatgaactgggtgaagcagagccatggagagagccttgagtggattggagatattaatccttacaacgatgatactacctacaaccacaagttcaagggcaaggccacattgactgtagacaaatcctccaacacagcctacatgcagctcaacagcctgacatctgaggactctgcagtctattactgtgcaagagagacggccgttattactacgaatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 213 - protein, 215 aa, Artificial Sequence
  Synthetic Polypeptide
  MISC_FEATURE: Humanized Antibody Sequence
DIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 214 - DNA, 645 bp, Artificial Sequence
  Synthetic Polynucleotide
  misc_feature: Humanized Antibody Sequence
gacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 215 - protein, 237 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - DNA, 711 bp, Artificial Sequence
  Synthetic Polynucleotide
  misc_feature: Humanized Antibody Sequence
atggacatgagggtccccgctcagctcctggggctcctgctactctggctcccaggtgccagatgtgacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 217 - protein, 447 aa, Artificial Sequence
  Synthetic Polypeptide
  MISC_FEATURE: Humanized Antibody Sequence
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 218 - DNA, 1341 bp, Artificial Sequence
  Synthetic Polynucleotide
  misc_feature: Humanized Antibody Sequence
gaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 219 - protein, 466 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 220 - DNA, 1398 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 221 - protein, 215 aa, Artificial Sequence
  Synthetic Polypeptide
  MISC_FEATURE: Humanized Antibody Sequence
DIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - DNA, 645 bp, Artificial Sequence
  Synthetic Polynucleotide
  misc_feature: Humanized Antibody Sequence
gacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 223 - protein, 237 aa, Artificial Sequence
  Synthetic Polypeptide
  MISC_FEATURE: Humanized Antibody Sequence
MDMRVPAQLLGLLLLWLRGARCDIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - DNA, 711 bp, Artificial Sequence
  Synthetic Polynucleotide
  misc_feature: Humanized Antibody Sequence
atggacatgagggtccccgctcagctcctggggctcctgctactctggctccgaggtgccagatgtgacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 225 - protein, 451 aa, Artificial Sequence
  Synthetic Polypeptide
  MISC_FEATURE: Humanized Antibody Sequence
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 226 - DNA, 1353 bp, Artificial Sequence
  Synthetic Polynucleotide
gaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 227 - protein, 470 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 228 - DNA, 1410 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 229 - protein, 213 aa, Artificial Sequence
  Synthetic Polypeptide
  MISC_FEATURE: Humanized Antibody Sequence
DIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 230 - DNA, 639 bp, Artificial Sequence
  Synthetic Polynucleotide
  misc_feature: Humanized Antibody Sequence
gacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 231 - protein, 235 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - DNA, 705 bp, Artificial Sequence
  Synthetic Polynucleotide
  misc_feature: Humanized Antibody Sequence
atggacatgagggtccccgctcagctcctggggctcctgctgctctggctcccaggtgccagatgtgacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 233 - protein, 447 aa, Artificial Sequence
  Synthetic Polypeptide
  MISC_FEATURE: Humanized Antibody Sequence
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 234 - DNA, 1341 bp, Artificial Sequence
  Synthetic Polynucleotide
  misc_feature: Humanized Antibody Sequence
gaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 235 - protein, 466 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 236 - DNA, 1398 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 237 - protein, 7 aa, Mus musculus
GTSNLAS

SEQ ID NO: 238 - protein, 8 aa, Mus musculus
QQWTTTYT

SEQ ID NO: 239 - protein, 11 aa, Mus musculus
RASQDISSYLN

SEQ ID NO: 240 - protein, 7 aa, Mus musculus
STSRLNS

SEQ ID NO: 241 - protein, 8 aa, Mus musculus
QQDIKHPT

SEQ ID NO: 242 - protein, 11 aa, Mus musculus
KASQDVFTAVA

SEQ ID NO: 243 - protein, 7 aa, Mus musculus
WASTRHT

SEQ ID NO: 244 - protein, 9 aa, Mus musculus
QQYSSYPLT

SEQ ID NO: 245 - protein, 5 aa, Mus musculus
DYNMH

SEQ ID NO: 246 - protein, 17 aa, Mus musculus
EINPNSGGAGYNQKFKG

SEQ ID NO: 247 - protein, 14 aa, Mus musculus
LGYDDIYDDWYFDV

SEQ ID NO: 248 - protein, 5 aa, Mus musculus
DYNMH

SEQ ID NO: 249 - protein, 17 aa, Mus musculus
EINPNSGGSGYNQKFKG

SEQ ID NO: 250 - protein, 14 aa, Mus musculus
LVYDGSYEDWYFDV

SEQ ID NO: 251 - protein, 5 aa, Mus musculus
DYNMH

SEQ ID NO: 252 - protein, 17 aa, Mus musculus
EINPNSGGAGYNQQFKG

SEQ ID NO: 253 - protein, 14 aa, Mus musculus
LGYVGNYEDWYFDV

SEQ ID NO: 254 - protein, 5 aa, Mus musculus
DYNMH

SEQ ID NO: 255 - protein, 17 aa, Mus musculus
EINPNSGGAGYNQKFKG

SEQ ID NO: 256 - protein, 14 aa, Mus musculus
LGYDDIYDDWYFDV

SEQ ID NO: 257 - protein, 5 aa, Mus musculus
DYNMH

SEQ ID NO: 258 - protein, 17 aa, Mus musculus
EINPNSGGAGYNQKFKG

SEQ ID NO: 259 - protein, 14 aa, Mus musculus
LGYDDIYDDWYFDV

SEQ ID NO: 260 - protein, 5 aa, Mus musculus
DYNMH

SEQ ID NO: 261 - protein, 17 aa, Mus musculus
EINPNSGGAGYNQKFKG

SEQ ID NO: 262 - protein, 14 aa, Mus musculus
LGYDDIYDDWYFDV

SEQ ID NO: 263 - protein, 5 aa, Mus musculus
DYNMH

SEQ ID NO: 264 - protein, 17 aa, Mus musculus
EINPNSGGSGYNQKFKG

SEQ ID NO: 265 - protein, 14 aa, Mus musculus
LGYYGNYEDWYFDV

SEQ ID NO: 266 - protein, 5 aa, Mus musculus
DYYIH

SEQ ID NO: 267 - protein, 17 aa, Mus musculus
RIDPDNGESTYVPKFQG

SEQ ID NO: 268 - protein, 13 aa, Mus musculus
EGLDYGDYYAVDY

SEQ ID NO: 269 - protein, 5 aa, Mus musculus
DYIMH

SEQ ID NO: 270 - protein, 17 aa, Mus musculus
YINPYNDDTEYNEKFKG

SEQ ID NO: 271 - protein, 11 aa, Mus musculus
SIYYYDAPFAY

SEQ ID NO: 272 - protein, 5 aa, Mus musculus
DYYMH

SEQ ID NO: 273 - protein, 17 aa, Mus musculus
RIDPENGDIIYDPKFQG

SEQ ID NO: 274 - protein, 10 aa, Mus musculus
DAGDPAWFTY

SEQ ID NO: 275 - protein, 10 aa, Mus musculus
RASSSVYYMH

SEQ ID NO: 276 - protein, 7 aa, Mus musculus
ATSNLAS

SEQ ID NO: 277 - protein, 9 aa, Mus musculus
QQWSSDPLT

SEQ ID NO: 278 - protein, 12 aa, Mus musculus
SVSSTISSNHLH

SEQ ID NO: 279 - protein, 7 aa, Mus musculus
GTSNLAS

SEQ ID NO: 280 - protein, 9 aa, Mus musculus
QQWSSYPLT

SEQ ID NO: 281 - protein, 10 aa, Mus musculus
RASSSISYIH

SEQ ID NO: 282 - protein, 7 aa, Mus musculus
ATSNLAS

SEQ ID NO: 283 - protein, 9 aa, Mus musculus
QQWSSDPLT

SEQ ID NO: 284 - protein, 12 aa, Mus musculus
RASSSVTSSYLN

SEQ ID NO: 285 - protein, 7 aa, Mus musculus
STSNLAS

SEQ ID NO: 286 - protein, 9 aa, Mus musculus
QQYDFFPST

SEQ ID NO: 287 - protein, 5 aa, Mus musculus
DYFIH

SEQ ID NO: 288 - protein, 17 aa, Mus musculus
RLDPEDGESDYAPKFQD

SEQ ID NO: 289 - protein, 12 aa, Mus musculus
EDYDGTYTFFPY

SEQ ID NO: 290 - protein, 5 aa, Mus musculus
DFYLH

SEQ ID NO: 291 - protein, 17 aa, Mus musculus
RIDPENGDTLYDPKFQD

SEQ ID NO: 292 - protein, 16 aa, Mus musculus
EADYFHDGTSYWYFDV

SEQ ID NO: 293 - protein, 5 aa, Mus musculus
DYYIH

SEQ ID NO: 294 - protein, 17 aa, Mus musculus
RVDPDNGETEFAPKFPG

SEQ ID NO: 295 - protein, 12 aa, Mus musculus
EDYDGTYTWFPY

SEQ ID NO: 296 - protein, 5 aa, Mus musculus
DYYMN

SEQ ID NO: 297 - protein, 17 aa, Mus musculus
DINPYNDDTTYNHKFKG

SEQ ID NO: 298 - protein, 11 aa, Mus musculus
ETAVITTNAMD

SEQ ID NO: 299 - protein, 130 aa, Mus musculus
MDFQVQIFSFMLISVTVILSSGEIVLTQSPALMAASPGEKVTITCSVSSSISSSNLHWSQQKSGTSPKLWIYGTSNLASGVPVRFSGSGSGTSYSLTISSMEAEDAATYYCQQWTTTYTFGSGTKLELKR

SEQ ID NO: 300 - DNA, 390 bp, Mus musculus
atggattttcaggtgcagattttcagcttcatgctaatcagtgtcacagtcatattgtccagtggagaaattgtgctcacccagtctccagcactcatggctgcatctccaggggagaaggtcaccatcacctgcagtgtcagctcgagtataagttccagcaacttacactggtcccagcagaagtcaggaacctcccccaaactctggatttatggcacatccaaccttgcttctggagtccctgttcgcttcagtggcagtggatctgggacctcttattctctcacaatcagcagcatggaggctgaagatgctgccacttattactgtcaacagtggactactacgtatacgttcggatcggggaccaagctggagctgaaacgt

SEQ ID NO: 301 - protein, 141 aa, Mus musculus
MGWNWIIFFLMAVVTGVNSEVQLRQSGADLVKPGASVKLSCTASGFNIKDYYIHWVKQRPEQGLEWIGRIDPDNGESTYVPKFQGKATITADTSSNTAYLQLRSLTSEDTAIYYCGREGLDYGDYYAVDYWGQGTSVTVSS

SEQ ID NO: 302 - DNA, 423 bp, Mus musculus
atgggatggaactggatcatcttcttcctgatggcagtggttacaggggtcaattcagaggtgcagttgcggcagtctggggcagaccttgtgaagccaggggcctcagtcaagttgtcctgcacagcttctggcttcaacattaaagactactatatacactgggtgaagcagaggcctgaacagggcctggagtggattggaaggattgatcctgataatggtgaaagtacatatgtcccgaagttccagggcaaggccactataacagcagacacatcatccaacacagcctacctacaactcagaagcctgacatctgaggacactgccatctattattgtgggagagaggggctcgactatggtgactactatgctgtggactactggggtcaaggaacctcggtcacagtctcgagc

SEQ ID NO: 303 - protein, 130 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCSVSSSISSSNLHWYQQKPGKAPKLLIYGTSNLASGVPSRFSGSGSGTEFTLTISSLQPEDFATYYCQQWTTTYTFGQGTKLEIKR

SEQ ID NO: 304 - DNA, 390 bp, Artificial Sequence
  Synthetic Polynucleotide
  misc_feature: Humanized Antibody Sequence
atggatatgcgcgtgccggcgcagctgctgggcctgctgctgctgtggctgccgggcgcgcgctgcgatattcagctgacccagagcccgagctttctgagcgcgagcgtgggcgatcgcgtgaccattacctgcagcgtgagcagcagcattagcagcagcaacctgcattggtatcagcagaaaccgggcaaagcgccgaaactgctgatttatggcaccagcaacctggcgagcggcgtgccgagccgctttagcggcagcggcagcggcaccgaatttaccctgaccattagcagcctgcagccggaagattttgcgacctattattgccagcagtggaccaccacctatacctttggccagggcaccaaactggaaattaaacgt

SEQ ID NO: 305 - protein, 141 aa, Artificial Sequence
  Synthetic Polypeptide
  MISC_FEATURE: Humanized Antibody Sequence
MDWTWSILFLVAAPTGAHSEVQLVQSGAEVKKPGASVKVSCKASGFNIKDYYIHWVRQAPGQGLEWMGRIDPDNGESTYVPKFQGRVTMTTDTSTSTAYMELRSLRSDDTAVYYCAREGLDYGDYYAVDYWGQGTLVTVSS

SEQ ID NO: 306 - DNA, 423 bp, Artificial Sequence
  Synthetic Polynucleotide
  misc_feature: Humanized Antibody Sequence
atggattggacctggagcattctgtttctggtggcggcgccgaccggcgcgcatagcgaagtgcagctggtgcagagcggcgcggaagtgaaaaaaccgggcgcgagcgtgaaagtgagctgcaaagcgagcggctttaacattaaagattattatattcattgggtgcgccaggcgccgggccagggcctggaatggatgggccgcattgatccggataacggcgaaagcacctatgtgccgaaatttcagggccgcgtgaccatgaccaccgataccagcaccagcaccgcgtatatggaactgcgcagcctgcgcagcgatgataccgcggtgtattattgcgcgcgcgaaggcctggattatggcgattattatgcggtggattattggggccagggcaccctggtgaccgtctcgagc

SEQ ID NO: 307 - protein, 127 aa, Artificial Sequence
  Synthetic Polypeptide
  MISC_FEATURE: Humanized Antibody Sequence
MMSSAQFLGLLLLCFQGTRCDIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKR

SEQ ID NO: 308 - DNA, 381 bp, Mus musculus
atgatgtcctctgctcagttccttggtctcctgttgctctgttttcaaggtaccagatgtgatatccagatgacacagactacatcctccctgtctgcctctctgggagacagagtcaacatcagctgcagggcaagtcaggacattagcagttatttaaactggtatcagcagaaaccagatggaactgttaaactcctgatctactccacatcaagattaaactcaggagtcccatcaaggttcagtggcagtgggtctgggacagattattctctcactattagcaacctggcacaagaagatattgccacttacttttgccaacaggatattaagcatccgacgttcggtggaggcaccaagttggagctgaaacgt

SEQ ID NO: 309 - protein, 139 aa, Mus musculus
MEWIWIFLFLLSGTAGVHSEVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSS

SEQ ID NO: 310 - DNA, 417 bp, Mus musculus
atggaatggatctggatatttctcttcctcctgtcaggaactgcaggtgtccactctgaggtccagctgcagcagtctggacctgagctggtaaagcctggggcttcagtgaagatgtcctgcaaggcttctgggttcacattcactgactacattatgcactgggtgaagcagaagcctgggcagggccttgagtggattggatatattaatccttacaatgatgatactgaatacaatgagaagttcaaaggcaaggccacactgacttcagacaaatcctccagcacagcctacatggatctcagcagtctgacctctgagggctctgcggtctattactgtgcaagatcgatttattactacgatgccccgtttgcttactggggccaagggactctggtcacagtctcgagc

SEQ ID NO: 311 - protein, 127 aa, Artificial Sequence
  Synthetic Polypeptide
  MISC_FEATURE: Humanized Antibody Sequence
MMSSAQFLGLLLLCFQGTRCDIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKR

SEQ ID NO: 312 - DNA, 381 bp, Artificial Sequence
  Synthetic Polynucleotide
  misc_feature: Humanized Antibody Sequence
atgatgtcctctgctcagttccttggtctcctgttgctctgttttcaaggtaccagatgtgatatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgt

SEQ ID NO: 313 - protein, 139 aa, Artificial Sequence
  Synthetic Polypeptide
  MISC_FEATURE: Humanized Antibody Sequence
MEWIWIFLFLLSGTAGVHSEVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSS

SEQ ID NO: 314 - protein, 107 aa, Mus musculus
DIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKR

SEQ ID NO: 315 - protein, 128 aa, Mus musculus
MKSQTQVFVYMLLWLSGVEGDIVMTQSHKFMSTSVGDRVTITCKASQDVFTAVAWYQQKPGQSPKLLIYWASTRHTGVPDRFTGSGSGTDFTLTISNVQSEDLADYFCQQYSSYPLTFGAGTKLELKR

SEQ ID NO: 316 - DNA, 381 bp, Mus musculus
atgaagtcacagacccaggtctttgtatacatgttgctgtggttgtctggtgttgaaggagacattgtgatgacccagtctcacaaattcatgtccacgtcagtaggagacagggtcaccatcacctgcaaggccagtcaggatgtctttactgctgtagcctggtatcaacagaaaccaggacaatctcctaaactactgatttactgggcatccacccggcacactggagtccctgatcgcttcacaggcagtggatctgggacagatttcactctcaccattagcaatgtgcagtctgaagacttggcagattatttctgtcaacaatatagcagctatcctctcacgttcggtgctgggaccaagttggagctgaaa

SEQ ID NO: 317 - protein, 138 aa, Mus musculus
MGWNWIIFFLMAVVTGVNSEVQLQQSGAELVRPGALVKLSCKASGFNIKDYYMHWVKQRPEQGLEWIGRIDPENGDIIYDPKFQGKASITTDTSSNTAYLQLSSLTSEDTAVYYCAYDAGDPAWFTYWGQGTLVTVSS

SEQ ID NO: 318 - DNA, 411 bp, Mus musculus
atgggatggaactggatcatcttcttcctgatggcagtggttacaggggtcaattcagaggttcagctgcagcagtctggggctgagcttgtgaggccaggggccttagtcaagttgtcctgcaaagcttctggcttcaatattaaagactactatatgcactgggtgaagcagaggcctgaacagggcctggagtggattggaaggattgatcctgagaatggtgatattatatatgacccgaagttccagggcaaggccagtataacaacagacacatcctccaacacagcctacctgcagctcagcagcctgacgtctgaggacactgccgtctattactgtgcttacgatgctggtgaccccgcctggtttacttactggggccaagggactctggtcaccgtctcg

SEQ ID NO: 319 - protein, 130 aa, Mus musculus
MDMRVPAQLLGLLLLWLRGARCDIQMTQSPSSLSASVGDRVTITCKASQDVFTAVAWYQQKPGKAPKLLIYWASTRHTGVPSRFSGSGSGTDFTLTISSLQPEDFATYYCQQYSSYPLTFGGGTKVEIKR

SEQ ID NO: 320 - DNA, 390 bp, Mus musculus
atggatatgcgcgtgccggcgcagctgctgggcctgctgctgctgtggctgcgcggcgcgcgctgcgatatccagatgacccagagcccgagcagcctgagcgcgagcgtgggcgatcgcgtgaccattacctgcaaagcgagccaggatgtgtttaccgcggtggcgtggtatcagcagaaaccgggcaaagcgccgaaactgctgatttattgggcgagcacccgccataccggcgtgccgagtcgctttagcggcagcggcagcggcaccgattttaccctgaccattagcagcctgcagccggaagattttgcgacctattattgccagcagtatagcagctatccgctgacctttggcggcggcaccaaagtggaaattaaacgt

SEQ ID NO: 321 - protein, 138 aa, Artificial Sequence
  Synthetic Polypeptide
  MISC_FEATURE: Humanized Antibody Sequence
MDWTWSILFLVAAPTGAHSEVQLVQSGAEVKKPGASVKVSCKASGFNIKDYYMHWVRQAPGQGLEWIGRIDPENGDIIYDPKFQGRVTMTTDTSTSTAYMELRSLRSDDTAVYYCAYDAGDPAWFTYWGQGTLVTVSS

SEQ ID NO: 322 - DNA, 414 bp, Artificial Sequence
  Synthetic Polynucleotide
  misc_feature: Humanized Antibody Sequence
atggattggacctggagcattctgtttctggtggcggcgccgaccggcgcgcatagcgaagtgcagctggtgcagagcggcgcggaagtgaaaaaaccgggcgcgagcgtgaaagtgagctgcaaagcgagcggctttaacattaaagattattatatgcattgggtgcgccaggcgccgggccagggcctggaatggatcggccgcattgatccggaaaacggcgatattatttatgatccgaaatttcagggccgcgtgaccatgaccaccgataccagcaccagcaccgcgtatatggaactgcgcagcctgcgcagcgatgataccgcggtgtattattgcgcgtatgatgcgggcgatccggcgtggtttacctattggggccagggcaccctggtgaccgtctcgagc

SEQ ID NO: 323 - protein, 106 aa, Mus musculus
TDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 324 - protein, 320 aa, Mus musculus
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSH

SEQ ID NO: 325 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 327 - protein, 120 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSS

SEQ ID NO: 328 - protein, 120 aa, Mus musculus; identical to SEQ ID NO: 327

SEQ ID NO: 329 - protein, 120 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSS

SEQ ID NO: 330 - protein, 226 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSSTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 447 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 332 - protein, 107 aa, Mus musculus
DIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIK

SEQ ID NO: 333 - protein, 324 aa, Mus musculus
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 334 - protein, 213 aa, Mus musculus
DIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 335 - protein, 444 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 336 - protein, 108 aa, Mus musculus
DIQMTQSPSSLSASVGDRVTITCKASQDVFTAVAWYQQKPGKAPKLLIYWASTRHTGVPSRFSGSGSGTDFTLTISSLQPEDFATYYCQQYSSYPLTFGGGTKVEIKR

SEQ ID NO: 337 - DNA, 324 bp, Mus musculus
gatatccagatgacccagagcccgagcagcctgagcgcgagcgtgggcgatcgcgtgaccattacctgcaaagcgagccaggatgtgtttaccgcggtggcgtggtatcagcagaaaccgggcaaagcgccgaaactgctgatttattgggcgagcacccgccataccggcgtgccgagtcgctttagcggcagcggcagcggcaccgattttaccctgaccattagcagcctgcagccggaagattttgcgacctattattgccagcagtatagcagctatccgctgacctttggcggcggcaccaaagtggaaattaaacgt

SEQ ID NO: 338 - protein, 119 aa, Mus musculus
EVQLVQSGAEVKKPGASVKVSCKASGFNIKDYYMHWVRQAPGQGLEWIGRIDPENGDIIYDPKFQGRVTMTTDTSTSTAYMELRSLRSDDTAVYYCAYDAGDPAWFTYWGQGTLVTVSS

SEQ ID NO: 339 - DNA, 357 bp, Mus musculus
gaagtgcagctggtgcagagcggcgcggaagtgaaaaaaccgggcgcgagcgtgaaagtgagctgcaaagcgagcggctttaacattaaagattattatatgcattgggtgcgccaggcgccgggccagggcctggaatggatcggccgcattgatccggaaaacggcgatattatttatgatccgaaatttcagggccgcgtgaccatgaccaccgataccagcaccagcaccgcgtatatggaactgcgcagcctgcgcagcgatgataccgcggtgtattattgcgcgtatgatgcgggcgatccggcgtggtttacctattggggccagggcaccctggtgaccgtctcgagc

SEQ ID NO: 340 - DNA, 1395 bp, Mus musculus
atggactggacctggaggatcctcttcttggtggcagcagccacaggagcccactccgaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 341 - protein, 213 aa, Mus musculus
DIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - DNA, 639 bp, Mus musculus
gacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 343 - protein, 235 aa, Mus musculus
MDMRVPAQLLGLLLLWLRGARCDIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 344 - DNA, 705 bp, Mus musculus
atggacatgagggtgcccgctcagctcctggggctcctgctgctgtggctgagaggtgccagatgtgacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 345 - protein, 446 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 346 - DNA, 1338 bp, Mus musculus
gaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 347 - protein, 465 aa, Mus musculus
MDWTWRILFLVAAATGAHSEVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 348 - DNA, 1395 bp, Mus musculus; identical to SEQ ID NO: 340

SEQ ID NO: 349 - DNA, 417 bp, Mus musculus
atggaatggatctggatatttctcttcctcctgtcaggaactgcaggtgtccactctgaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcacagtctcgagc

SEQ ID NO: 350 - protein, 218 aa, Mus musculus
DIVLTQSPASLAVSLGQRATIACKASQSVDYDGTSYMNWYQQKPGQPPKLLIYAASNLESEIPARFSGTGSGTDFTLNIHPVEEEDITTYYCQQSNEDPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 351 - protein, 15 aa, Mus musculus
KASQSVDYDGTSYMN

SEQ ID NO: 352 - protein, 7 aa, Mus musculus
AASNLES

SEQ ID NO: 353 - protein, 9 aa, Mus musculus
QQSNEDPFT

SEQ ID NO: 354 - DNA, 657 bp, Mus musculus
gacattgtgttgacccagtctccagcttctttggctgtgtctctagggcagagggccaccatcgcctgcaaggccagccaaagtgttgattatgatggtactagttatatgaattggtaccaacagaaaccaggacagccacccaaactcctcatctatgctgcatccaatctagaatctgagatcccagccaggtttagtggcactgggtctgggacagacttcaccctcaacatccatcctgtggaggaggaggatatcacaacctattactgtcagcaaagtaatgaggatccgttcacgttcggaggggggaccaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 355 - protein, 238 aa, Mus musculus
METDTILLWVLLLWVPGSTGDIVLTQSPASLAVSLGQRATIACKASQSVDYDGTSYMNWYQQKPGQPPKLLIYAASNLESEIPARFSGTGSGTDFTLNIHPVEEEDITTYYCQQSNEDPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 356 - DNA, 717 bp, Mus musculus
atggagacagacacaatcctgctatgggtgctgctgctctgggttccaggctccactggtgacattgtgttgacccagtctccagcttctttggctgtgtctctagggcagagggccaccatcgcctgcaaggccagccaaagtgttgattatgatggtactagttatatgaattggtaccaacagaaaccaggacagccacccaaactcctcatctatgctgcatccaatctagaatctgagatcccagccaggtttagtggcactgggtctgggacagacttcaccctcaacatccatcctgtggaggaggaggatatcacaacctattactgtcagcaaagtaatgaggatccgttcacgttcggaggggggaccaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 357 - protein, 442 aa, Mus musculus
QVQLQQPGTELVRPGTSVKLSCKASGYIFTTYWMNWVKQRPGQGLEWIGMIHPSASEIRLDQKFKDKATLTLDKSSSTAYMHLSGPTSVDSAVYYCARSGEWGSMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 358 - protein, 5 aa, Mus musculus
TYWMN

SEQ ID NO: 359 - protein, 17 aa, Mus musculus
MIHPSASEIRLDQKFKD

SEQ ID NO: 360 - protein, 9 aa, Mus musculus
SGEWGSMDY

SEQ ID NO: 361 - DNA, 1329 bp, Mus musculus
caggtccaactacagcagcctgggactgagctggtgaggcctggaacttcagtgaagttgtcctgtaaggcttctggctacatcttcaccacctactggatgaactgggtgaaacagaggcctggacaaggccttgagtggattggcatgattcatccttccgcaagtgaaattaggttggatcagaaattcaaggacaaggccacattgactcttgacaaatcctccagcacagcctatatgcacctcagcggcccgacatctgtggattctgcggtctattactgtgcaagatcaggggaatgggggtctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 362 - protein, 461 aa, Mus musculus
MGWSSIILFLVATATGVHSQVQLQQPGTELVRPGTSVKLSCKASGYIFTTYWMNWVKQRPGQGLEWIGMIHPSASEIRLDQKFKDKATLTLDKSSSTAYMHLSGPTSVDSAVYYCARSGEWGSMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 363 - DNA, 1386 bp, Mus musculus
atgggatggagctctatcatcctcttcttggtagcaacagctacaggtgtccactcccaggtccaactacagcagcctgggactgagctggtgaggcctggaacttcagtgaagttgtcctgtaaggcttctggctacatcttcaccacctactggatgaactgggtgaaacagaggcctggacaaggccttgagtggattggcatgattcatccttccgcaagtgaaattaggttggatcagaaattcaaggacaaggccacattgactcttgacaaatcctccagcacagcctatatgcacctcagcggcccgacatctgtggattctgcggtctattactgtgcaagatcaggggaatgggggtctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 364 - protein, 106 aa, Mus musculus
DIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIK

SEQ ID NO: 365 - DNA, 318 bp, Mus musculus
gacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaa

SEQ ID NO: 366 - protein, 120 aa, Mus musculus; identical to SEQ ID NO: 329

SEQ ID NO: 367 - DNA, 360 bp, Mus musculus
gaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagt

SEQ ID NO: 368 - protein, 108 aa, Mus musculus; identical to SEQ ID NO: 336

SEQ ID NO: 369 - DNA, 324 bp, Mus musculus; identical to SEQ ID NO: 337

SEQ ID NO: 370 - protein, 119 aa, Mus musculus; identical to SEQ ID NO: 338

SEQ ID NO: 371 - DNA, 357 bp, Mus musculus; identical to SEQ ID NO: 339

SEQ ID NO: 372 - protein, 108 aa, Mus musculus
DIQLTQSPSFLSASVGDRVTITCSVSSSISSSNLHWYQQKPGKAPKLLIYGTSNLASGVPSRFSGSGSGTEFTLTISSLQPEDFATYYCQQWTTTYTFGQGTKLEIKR

SEQ ID NO: 373 - DNA, 324 bp, Mus musculus
gatattcagctgacccagagcccgagctttctgagcgcgagcgtgggcgatcgcgtgaccattacctgcagcgtgagcagcagcattagcagcagcaacctgcattggtatcagcagaaaccgggcaaagcgccgaaactgctgatttatggcaccagcaacctggcgagcggcgtgccgagccgctttagcggcagcggcagcggcaccgaatttaccctgaccattagcagcctgcagccggaagattttgcgacctattattgccagcagtggaccaccacctatacctttggccagggcaccaaactggaaattaaacgt

SEQ ID NO: 374 - protein, 122 aa, Mus musculus
EVQLVQSGAEVKKPGASVKVSCKASGFNIKDYYIHWVRQAPGQGLEWMGRIDPDNGESTYVPKFQGRVTMTTDTSTSTAYMELRSLRSDDTAVYYCAREGLDYGDYYAVDYWGQGTLVTVSS

SEQ ID NO: 375 - DNA, 366 bp, Mus musculus
gaagtgcagctggtgcagagcggcgcggaagtgaaaaaaccgggcgcgagcgtgaaagtgagctgcaaagcgagcggctttaacattaaagattattatattcattgggtgcgccaggcgccgggccagggcctggaatggatgggccgcattgatccggataacggcgaaagcacctatgtgccgaaatttcagggccgcgtgaccatgaccaccgataccagcaccagcaccgcgtatatggaactgcgcagcctgcgcagcgatgataccgcggtgtattattgcgcgcgcgaaggcctggattatggcgattattatgcggtggattattggggccagggcaccctggtgaccgtctcgagc

SEQ ID NO: 376 - protein, 107 aa, Mus musculus [sequence omitted]

SEQ ID NO: 377 - DNA, 321 bp, Mus musculus
gacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaa

SEQ ID NO: 378 - protein, 123 aa, Mus musculus [sequence omitted]

SEQ ID NO: 379 - DNA, 369 bp, Mus musculus
gaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagt

SEQ ID NO: 380 - protein, 108 aa, Mus musculus
DIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIK

SEQ ID NO: 381 - DNA, 324 bp, Mus musculus
gacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaag

SEQ ID NO: 382 - protein, 121 aa, Mus musculus
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSS

SEQ ID NO: 383 - DNA, 363 bp, Mus musculus
gaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagt

SEQ ID NO: 384 - protein, 108 aa, Mus musculus
DIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIK

SEQ ID NO: 385 - DNA, 324 bp, Mus musculus
gacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaa

SEQ ID NO: 386 - protein, 125 aa, Mus musculus
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSS

SEQ ID NO: 387 - DNA, 375 bp, Mus musculus
gaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagt

SEQ ID NO: 388 - protein, 106 aa, Mus musculus
DIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIK

SEQ ID NO: 389 - DNA, 318 bp, Mus musculus
gacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaa

SEQ ID NO: 390 - protein, 121 aa, Mus musculus
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSS

SEQ ID NO: 391 - DNA, 363 bp, Mus musculus
gaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagt

SEQ ID NO: 392 - protein, 448 aa, Artificial Sequence
  Synthetic Polypeptide
  MISC_FEATURE: Humanized Antibody Sequence
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 393 - protein, 446 aa, Artificial Sequence
  Synthetic Polypeptide
  MISC_FEATURE: Humanized Antibody Sequence
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 394 - protein, 450 aa, Artificial Sequence
  Synthetic Polypeptide
  MISC_FEATURE: Humanized Antibody Sequence
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 395 - protein, 446 aa, Artificial Sequence
  Synthetic Polypeptide
  MISC_FEATURE: Humanized Antibody Sequence
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 396 - protein, 445 aa, Artificial Sequence
  Synthetic Polypeptide
  MISC_FEATURE: Humanized Antibody Sequence
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 397 - protein, 213 aa, Homo sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 398 - protein, 444 aa, Artificial
  Miscellaneous construct
QVQLVQSGAEVKKPGSSVKVSCKASGYTFTDYFLNWVRQAPGQGLEWMGTIYPYHDGTTYSQKFKGRVTITADKSTSTAYMELSSLRSEDTAVYYCAREEEDGQFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 399 - protein, 444 aa, Artificial
  Miscellaneous construct
QVQLVQSGAEVKKPGASVKVSCKVSGFPIKDTFQHWVRQAPGKGLEWMGWSDPEIGDTEYASKFQGRVTMTEDTSTDTAYMELSSLRSEDTAVYYCATGDTTYKFDFWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 400 - protein, 450 aa, Artificial
  Miscellaneous construct
EVQLVQSGAEVKKPGESLKISCKGSDFEIKDYYIHWVRQMPGKGLEWMGQIDAEDGETEYAPRFQGQVTISADKSISTAYLQWSSLKASDTAMYYCAREGYYYDGRDYWYFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 401 - protein, 214 aa, Artificial
  Miscellaneous construct
DIQMTQSPSSLSASVGDRVTITCSASQGIQWYLNWYQQKPGKAPKLLIYYTSSLHSGVPSRFSGSGSGTDFTLTISSLQPEDFATYYCQQHSKLPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 402 - protein, 214 aa, Artificial
  Miscellaneous construct
DIQMTQSPSSLSASVGDRVTITCKASQDVHTAVAWYQQKPGKAPKLLIYWASTRWTGVPSRFSGSGSGTDFTLTISSLQPEDFATYYCQQYSDYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 403 - protein, 213 aa, Artificial
  Miscellaneous construct
EIVLTQSPATLSLSPGERATLSCSASSSVSYIHWYQQKPGQAPRLLIYSTSELASGIPARFSGSGSGTDFTLTISSLEPEDFAVYYCQQLSHLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - DNA, 1332 bp, Artificial
  Miscellaneous construct
caggtgcagctggtgcagtctggggctgaggtgaagaagcctgggtcctcagtgaaggtttcctgcaaggcatctggatacacattcactgactactttctgaactgggtgcgacaggcccctggacaagggcttgagtggatgggaactatttatccttaccatgatggtactacctactctcagaagttcaagggcagagtcaccattaccgcggacaaatccacgagcacagcctacatggagctgagcagcctgagatctgaggacacggccgtgtattactgtgcgagagaggaagaggatggtcagttcgactactggggccaaggaaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 405 - DNA, 1332 bp, Artificial
  Miscellaneous construct
caggttcagctggtgcagtctggggctgaggtgaagaagcctggggcctcagtgaaggtctcctgcaaggtttccggcttccccattaaggacacctttcagcactgggtgcgacaggctcctggaaaagggcttgagtggatgggatggagcgatcctgagatcggtgatactgaatatgcctcgaagttccagggcagagtcaccatgaccgaggacacatctacagacacagcctacatggagctgagcagcctgagatctgaggacacggccgtgtattactgtgcaacaggcgacaccacatacaagtttgacttctgggggcaagggaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 406 - DNA, 1350 bp, Artificial
  Miscellaneous construct
gaggtgcagctggtgcagtctggagcagaggtgaaaaagcccggggagtctctgaagatctcctgtaagggttctgacttcgagattaaagactactatatacattgggtgcgccagatgcccgggaaaggcctggagtggatggggcagattgatgctgaggatggtgaaactgaatatgccccgaggttccagggccaggtcaccatctcagccgacaagtccatcagcaccgcctacctgcagtggagcagcctgaaggcctcggacaccgccatgtattactgtgcgagagagggttattactacgatgggcgcgactactggtacttcgatgtctggggccaagggaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 407 - DNA, 642 bp, Artificial
  Miscellaneous construct
gacatccagatgacccagtctccatcctctctgtctgcatctgtaggagacagagtcaccatcacttgcagtgcaagtcagggcattcagtggtatttaaactggtatcagcagaaaccagggaaagcccctaagctcctgatctattacacatcaagtttacactcaggggtcccatcaaggttcagtggcagtggatctgggacagatttcactctcaccatcagcagtctgcaacctgaagattttgcaacttactactgtcagcagcatagtaaacttcctcggacgttcggcggagggaccaaggtggagatcaaacggactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 408 - DNA, 642 bp, Artificial
  Miscellaneous construct
gacatccagatgacccagtctccatcctccctgtctgcatctgtaggagacagagtcaccatcacttgcaaggccagtcaggatgtgcacactgctgtagcctggtatcagcagaaaccagggaaagcccctaagctcctgatctattgggcatccacccggtggactggagtcccatcaaggttcagtggcagtggatctgggacagatttcactctcaccatcagcagtctgcaacctgaagattttgcaacttactactgtcagcaatatagcgattatccgtggacgttcggcggagggaccaaggtggagatcaaacggactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 409 - DNA, 639 bp, Artificial
  Miscellaneous construct
gaaattgtgttgacacagtctccagccaccctgtctttgtctccaggggaaagagccaccctctcctgcagtgccagctcaagtgtaagttacatccactggtaccaacagaaacctggccaggctcccaggctcctcatctatagcacatccgagctggcttctggcatcccagccaggttcagtggcagtgggtctgggacagacttcactctcaccatcagcagcctagagcctgaagattttgcagtttattactgtcagcagcttagtcatctcccgctcacgttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 410 - protein, 118 aa, Artificial
  Miscellaneous construct
QVQLVQSGAEVKKPGSSVKVSCKASGYTFTDYFLNWVRQAPGQGLEWMGTIYPYHDGTTYSQKFKGRVTITADKSTSTAYMELSSLRSEDTAVYYCAREEEDGQFDYWGQGTTVTVSS

SEQ ID NO: 411 - protein, 118 aa, Artificial [sequence omitted]

SEQ ID NO: 412 - protein, 124 aa, Artificial
  Miscellaneous construct
EVQLVQSGAEVKKPGESLKISCKGSDFEIKDYYIHWVRQMPGKGLEWMGQIDAEDGETEYAPRFQGQVTISADKSISTAYLQWSSLKASDTAMYYCAREGYYYDGRDYWYFDVWGQGTTVTVSS

SEQ ID NO: 413 - protein, 107 aa, Artificial
  Miscellaneous construct
DIQMTQSPSSLSASVGDRVTITCSASQGIQWYLNWYQQKPGKAPKLLIYYTSSLHSGVPSRFSGSGSGTDFTLTISSLQPEDFATYYCQQHSKLPRTFGGGTKVEIK

SEQ ID NO: 414 - protein, 107 aa, Artificial [sequence omitted]

SEQ ID NO: 415 - protein, 106 aa, Artificial
  Miscellaneous construct
EIVLTQSPATLSLSPGERATLSCSASSSVSYIHWYQQKPGQAPRLLIYSTSELASGIPARFSGSGSGTDFTLTISSLEPEDFAVYYCQQLSHLPLTFGGGTKVEIK

SEQ ID NO: 416 - protein, 10 aa, Artificial
  Miscellaneous construct
GYTFTDYFLN

SEQ ID NO: 417 - protein, 17 aa, Artificial
  Miscellaneous construct
TIYPYHDGTTYSQKFKG

SEQ ID NO: 418 - protein, 9 aa, Artificial
  Miscellaneous construct
EEEDGQFDY

SEQ ID NO: 419 - protein, 11 aa, Artificial
  Miscellaneous construct
SASQGIQWYLN

SEQ ID NO: 420 - protein, 7 aa, Artificial
  Miscellaneous construct
YTSSLHS

SEQ ID NO: 421 - protein, 9 aa, Artificial
  Miscellaneous construct
QQHSKLPRT

SEQ ID NO: 422 - protein, 10 aa, Artificial
  Miscellaneous construct
GFPIKDTFQH

SEQ ID NO: 423 - protein, 17 aa, Artificial
  Miscellaneous construct
WSDPEIGDTEYASKFQG

SEQ ID NO: 424 - protein, 9 aa, Artificial
  Miscellaneous construct
GDTTYKFDF

SEQ ID NO: 425 - protein, 11 aa, Artificial
  Miscellaneous construct
KASQDVHTAVA

SEQ ID NO: 426 - protein, 7 aa, Artificial
  Miscellaneous construct
WASTRWT

SEQ ID NO: 427 - protein, 9 aa, Artificial
  Miscellaneous construct
QQYSDYPWT

SEQ ID NO: 428 - protein, 10 aa, Artificial
  Miscellaneous construct
DFEIKDYYIH

SEQ ID NO: 429 - protein, 17 aa, Artificial
  Miscellaneous construct
QIDAEDGETEYAPRFQG

SEQ ID NO: 430 - protein, 17 aa, Artificial
  Miscellaneous construct
QIDAEDGETEYAPRFQG

SEQ ID NO: 431 - protein, 17 aa, Artificial
  Miscellaneous construct
QIDAEDGETEYAPRFQG

SEQ ID NO: 432 - protein, 7 aa, Artificial
  Miscellaneous construct
STSELAS

SEQ ID NO: 433 - protein, 9 aa, Artificial
  Miscellaneous construct
QQLSHLPLT

SEQ ID NO: 434 - protein, 322 aa, Artificial
  Miscellaneous construct
GPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 435 - DNA, 970 bp, Artificial
  Miscellaneous construct
ggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccgctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggttga

SEQ ID NO: 436 - protein, 444 aa, Artificial
  Miscellaneous construct
EVQLQQSVAELVRPGASVKLSCTASGFNIKSTFMHWVKQRPDQGLEWIGWIDPENGDTEYASKFQGKATMTADTSSNTAYLQLSSLTSEDTAVYYCTTGESNYDFDFWGLGTTLTVSSAKTTPPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 437 - protein, 214 aa, Artificial
  Miscellaneous construct
DIVMTQSHKFMSTSVGDRVSITCKASQDVSTAVAWYQQKPGQSPKLLIYWASTRHTGVPDRFTGSGSGTDYTLTISDVQSEDLADYFCQQYSNYPWTFGGGTKLEIKRADAAPTVSIFPPSTEQLATGGASVVCLMNNFYPRDISVKWKIDGTERRDGVLDSVTDQDSKDSTYSMSSTLSLSKADYESHNLYTCEVVHKTSSSPVVKSFNRNEC

SEQ ID NO: 438 - protein, 450 aa, Artificial
  Miscellaneous construct
EVQLQQSGAEHVKPGASVKLSCTASDFNIKDYYIHWVKQRTAQGLEWIGRIDPEDGETEYAPRFQGKATIIADTSSNTAYLQLSSLTSEDTAVYYCAREGYYYDSRDYWYFDVWGTGTTVTVSSAKTTPPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 439 - protein, 213 aa, Artificial
  Miscellaneous construct
EIVLTQSPALMSASPGEKVTMTCSASSSVSYMHWFQQKPGTSPKLWIYSTSNLASGVPARFSGSGSGTSYSLTISSMEAEDAATYYCQQWSSNPLTFGAGTKLELKRADAAPTVSIFPPSTEQLATGGASVVCLMNNFYPRDISVKWKIDGTERRDGVLDSVTDQDSKDSTYSMSSTLSLSKADYESHNLYTCEVVHKTSSSPVVKSFNRNEC

SEQ ID NO: 440 - protein, 10 aa, Homo sapiens
GFTFSSYVMN

SEQ ID NO: 441 - protein, 10 aa, Homo sapiens
GFTFRSHWLS

SEQ ID NO: 442 - protein, 10 aa, Homo sapiens
GFTFSSYVMN

SEQ ID NO: 443 - protein, 10 aa, Homo sapiens
GFTFRSHWLS

SEQ ID NO: 444 - protein, 10 aa, Homo sapiens
GFTFRSHWLS

SEQ ID NO: 445 - protein, 10 aa, Homo sapiens
GFTFRSHWLS

SEQ ID NO: 446 - protein, 10 aa, Homo sapiens
GFTFRSHWLS

SEQ ID NO: 447 - protein, 10 aa, Homo sapiens
GFTFRSHWLS

SEQ ID NO: 448 - protein, 10 aa, Homo sapiens
GFTFRSHWLS

SEQ ID NO: 449 - protein, 10 aa, Homo sapiens
GFTFRSHWLS

SEQ ID NO: 450 - protein, 10 aa, Homo sapiens
GFTFRSHWLS

SEQ ID NO: 451 - protein, 20 aa, Homo sapiens
WVSFISGDSSNTYYADSVKG

SEQ ID NO: 452 - protein, 20 aa, Homo sapiens
WVSNINYDGSSTYYADSVKG

SEQ ID NO: 453 - protein, 20 aa, Homo sapiens
WVSFISGDSSNTYYADSVKG

SEQ ID NO: 454 - protein, 20 aa, Homo sapiens
WVSNINYDGSSTYYADSVKG

SEQ ID NO: 455 - protein, 19 aa, Homo sapiens
WVSVTGVHGDTYYADSVKG

SEQ ID NO: 456 - protein, 19 aa, Homo sapiens
WVSVIGNWGDTYYADSVKG

SEQ ID NO: 457 - protein, 19 aa, Homo sapiens
WVSVTTHQGYTYYADSVKG

SEQ ID NO: 458 - protein, 19 aa, Homo sapiens
WVSATNRYGYTYYADSVKG

SEQ ID NO: 459 - protein, 20 aa, Homo sapiens
WVSNINYDGSSTYYADSVKG

SEQ ID NO: 460 - protein, 19 aa, Homo sapiens
WVSVITPYGDTYYADSVKG

SEQ ID NO: 461 - protein, 19 aa, Homo sapiens
WVSVITPYGDTYYADSVKG

SEQ ID NO: 462 - protein, 15 aa, Homo sapiens
TFMHGHLGGGLSMDF

SEQ ID NO: 463 - protein, 8 aa, Homo sapiens
DTYLHFDY

SEQ ID NO: 464 - protein, 15 aa, Homo sapiens
TFMHGHLGGGLSMDF

SEQ ID NO: 465 - protein, 8 aa, Homo sapiens
DTYLHFDY

SEQ ID NO: 466 - protein, 8 aa, Homo sapiens
DTYLHFDY

SEQ ID NO: 467 - protein, 8 aa, Homo sapiens
DTYLHFDY

SEQ ID NO: 468 - protein, 8 aa, Homo sapiens
DTYLHFDY

SEQ ID NO: 469 - protein, 8 aa, Homo sapiens
DTYLHFDY

SEQ ID NO: 470 - protein, 8 aa, Homo sapiens
DTYLHFDY

SEQ ID NO: 471 - protein, 8 aa, Homo sapiens
DTYLHFDY

SEQ ID NO: 472 - protein, 8 aa, Homo sapiens
DTYLHFDY

SEQ ID NO: 473 - protein, 11 aa, Homo sapiens
SGDNIGSFYVH

SEQ ID NO: 474 - protein, 20 aa, Homo sapiens
WVSNINYDGSSTYYADSVKG

SEQ ID NO: 475 - protein, 20 aa, Homo sapiens
WVSNINYDGSSTYYADSVKG

SEQ ID NO: 476 - protein, 11 aa, Homo sapiens
SGDNIGSFYVH

SEQ ID NO: 477 - protein, 14 aa, Homo sapiens
TGTSSDVGDINDVS

SEQ ID NO: 478 - protein, 14 aa, Homo sapiens
TGTSSDVGDINDVS

SEQ ID NO: 479 - protein, 14 aa, Homo sapiens
TGTSSDVGDINDVS

SEQ ID NO: 480 - protein, 14 aa, Homo sapiens
TGTSSDVGDINDVS

SEQ ID NO: 481 - protein, 14 aa, Homo sapiens
TGTSSDVGDINDVS

SEQ ID NO: 482 - protein, 14 aa, Homo sapiens
TGTSSDVGDINDVS

SEQ ID NO: 483 - protein, 14 aa, Homo sapiens
TGTSSDVGDINDVS

SEQ ID NO: 484 - protein, 11 aa, Homo sapiens
LVIYDDNNRPS

SEQ ID NO: 485 - protein, 11 aa, Homo sapiens
LMIYDVNNRPS

SEQ ID NO: 486 - protein, 11 aa, Homo sapiens
LVIYDDNNRPS

SEQ ID NO: 487 - protein, 11 aa, Homo sapiens
LMIYDVNNRPS

SEQ ID NO: 488 - protein, 11 aa, Homo sapiens
LMIYDVNNRPS

SEQ ID NO: 489 - protein, 11 aa, Homo sapiens
LMIYDVNNRPS

SEQ ID NO: 490 - protein, 11 aa, Homo sapiens
LMIYDVNNRPS

SEQ ID NO: 491 - protein, 11 aa, Homo sapiens
LMIYDVNNRPS

SEQ ID NO: 492 - protein, 11 aa, Homo sapiens
LMIYDVNNRPS

SEQ ID NO: 493 - protein, 11 aa, Homo sapiens
LMIYDVNNRPS

SEQ ID NO: 494 - protein, 11 aa, Homo sapiens
LMIYDVNNRPS

SEQ ID NO: 495 - protein, 10 aa, Homo sapiens
GSWAGSSGSY

SEQ ID NO: 496 - protein, 10 aa, Homo sapiens
SSYGESLTSY

SEQ ID NO: 497 - protein, 10 aa, Homo sapiens
ASWTGVEPDY

SEQ ID NO: 498 - protein, 10 aa, Homo sapiens
QSYAGSYLSE

SEQ ID NO: 499 - protein, 10 aa, Homo sapiens
SSYGESLTSY

SEQ ID NO: 500 - protein, 10 aa, Homo sapiens
SSYGESLTSY

SEQ ID NO: 501 - protein, 10 aa, Homo sapiens
SSYGESLTSY

SEQ ID NO: 502 - protein, 10 aa, Homo sapiens
SSYGESLTSY

SEQ ID NO: 503 - protein, 10 aa, Homo sapiens
STYDGPGLSE

SEQ ID NO: 504 - protein, 10 aa, Homo sapiens
SSYGESLTSY

SEQ ID NO: 505 - protein, 10 aa, Homo sapiens
SSYGESLTSY

SEQ ID NO: 506 - protein, 124 aa, Homo sapiens
QVQLVESGGGLVQPGGSLRLSCAASGFTFSSYVMNWVRQAPGKGLEWVSFISGDSSNTYYADSVKGRFTISRDNSKNTLYLQMNSLRAEDTAVYYCARTFMHGHLGGGLSMDFWGQGTLVTVSS

SEQ ID NO: 507 - protein, 117 aa, Homo sapiens
QVQLVESGGGLVQPGGSLRLSCAASGFTFRSHWLSWVRQAPGKGLEWVSNINYDGSSTYYADSVKGRFTISRDNSKNTLYLQMNSLRAEDTAVYYCARDTYLHFDYWGQGTLVTVSS

SEQ ID NO: 508 - protein, 124 aa, Homo sapiens; identical to SEQ ID NO: 506

SEQ ID NO: 509 - protein, 117 aa, Homo sapiens; identical to SEQ ID NO: 507

SEQ ID NO: 510 - protein, 116 aa, Homo sapiens
QVQLVESGGGLVQPGGSLRLSCAASGFTFRSHWLSWVRQAPGKGLEWVSVTGVHGDTYYADSVKGRFTISRDNSKNTLYLQMNSLRAEDTAVYYCARDTYLHFDYWGQGTLVTVSS

SEQ ID NO: 511 - protein, 116 aa, Homo sapiens
QVQLVESGGGLVQPGGSLRLSCAASGFTFRSHWLSWVRQAPGKGLEWVSVIGNWGDTYYADSVKGRFTISRDNSKNTLYLQMNSLRAEDTAVYYCARDTYLHFDYWGQGTLVTVSS

SEQ ID NO: 512 - protein, 116 aa, Homo sapiens
QVQLVESGGGLVQPGGSLRLSCAASGFTFRSHWLSWVRQAPGKGLEWVSVTTHQGYTYYADSVKGRFTISRDNSKNTLYLQMNSLRAEDTAVYYCARDTYLHFDYWGQGTLVTVSS

SEQ ID NO: 513 - protein, 116 aa, Homo sapiens
QVQLVESGGGLVQPGGSLRLSCAASGFTFRSHWLSWVRQAPGKGLEWVSATNRYGYTYYADSVKGRFTISRDNSKNTLYLQMNSLRAEDTAVYYCARDTYLHFDYWGQGTLVTVSS

SEQ ID NO: 514 - protein, 117 aa, Homo sapiens; identical to SEQ ID NO: 507

SEQ ID NO: 515 - protein, 116 aa, Homo sapiens
QVQLVESGGGLVQPGGSLRLSCAASGFTFRSHWLSWVRQAPGKGLEWVSVITPYGDTYYADSVKGRFTISRDNSKNTLYLQMNSLRAEDTAVYYCARDTYLHFDYWGQGTLVTVSS

SEQ ID NO: 516 - protein, 116 aa, Homo sapiens; identical to SEQ ID NO: 515

SEQ ID NO: 517 - protein, 110 aa, Homo sapiens
DIELTQPPSVSVAPGQTARISCSGDNIGSFYVHWYQQKPGQAPVLVIYDDNNRPSGIPERFSGSNSGNTATLTISGTQAEDEADYYCGSWAGSSGSYVFGGRTKLTVLGQ

SEQ ID NO: 518 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCSSYGESLTSYVFGGGTKLTVLGQ

SEQ ID NO: 519 - protein, 110 aa, Homo sapiens
DIELTQPPSVSVAPGQTARISCSGDNIGSFYVHWYQQKPGQAPVLVIYDDNNRPSGIPERFSGSNSGNTATLTISGTQAEDEADYYCASWTGVEPDYVFGGGTKLTVLGQ

SEQ ID NO: 520 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCQSYAGSYLSEVFGGGTKLTVLGQ

SEQ ID NO: 521 - protein, 113 aa, Homo sapiens; identical to SEQ ID NO: 518

SEQ ID NO: 522 - protein, 113 aa, Homo sapiens; identical to SEQ ID NO: 518

SEQ ID NO: 523 - protein, 113 aa, Homo sapiens; identical to SEQ ID NO: 518

SEQ ID NO: 524 - protein, 113 aa, Homo sapiens; identical to SEQ ID NO: 518

SEQ ID NO: 525 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCSTYDGPGLSEVFGGGTKLTVLGQ

SEQ ID NO: 526 - protein, 113 aa, Homo sapiens; identical to SEQ ID NO: 518

SEQ ID NO: 527 - protein, 113 aa, Homo sapiens; identical to SEQ ID NO: 525

SEQ ID NO: 528 - DNA, 372 bp, Homo sapiens
caggtgcaattggtggaaagcggcggcggcctggtgcaaccgggcggcagcctgcgtctgagctgcgcggcctccggatttaccttttcttcttatgttatgaattgggtgcgccaagcccctgggaagggtctcgagtgggtgagctttatctctggtgattctagcaatacctattatgcggatagcgtgaaaggccgttttaccatttcacgtgataattcgaaaaacaccctgtatctgcaaatgaacagcctgcgtgcggaagatacggccgtgtattattgcgcgcgtacttttatgcatggtcatcttggtggtggtctttctatggatttttggggccaaggcaccctggtgacggttagctca

SEQ ID NO: 529 - DNA, 350 bp, Homo sapiens
caggtgcaattggtggaaagcggcggcggcctggtgcaaccgggcggcagcctgcgtctagctgcgcggcctccggatttacctttcgttctcattggctttcttgggtgcgccaagcccctgggaagggtctcgagtgggtgagcaatatcaattatgatggtagctctacctattatgcggatagcgtgaaaggccgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 530 - DNA, 372 bp, Homo sapiens; identical to SEQ ID NO: 528

SEQ ID NO: 531 - DNA, 351 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcaatatcaattatgatggtagctctacctattatgcggatagcgtgaaaggccgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 532 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttactggtgttcatggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 533 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttattggtaattggggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 534 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttactactcatcagggttatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 535 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgctactaatcgttatggttatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 536 - DNA, 351 bp, Homo sapiens; identical to SEQ ID NO: 531

SEQ ID NO: 537 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttattactccttatggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 538 - DNA, 348 bp, Homo sapiens; identical to SEQ ID NO: 537

SEQ ID NO: 539 - DNA, 330 bp, Homo sapiens
gatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcggttcttgggctggttcttctggttcttatgtgtttggcggccgcacgaagttaaccgttcttggccag

SEQ ID NO: 540 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgctcttcttatggtgagtctcttacttcttatgtgtttggcggcggcacgaagttaaccgttcttggccag

SEQ ID NO: 541 - DNA, 330 bp, Homo sapiens
gatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcgcttcttggactggtgttgagcctgattatgtgtttggcggcggcacgaagttaaccgttcttggccag

SEQ ID NO: 542 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgccagtcttatgctggttcttatctttctgaggtgtttggcggcggcacgaagttaaccgttcttggccag

SEQ ID NO: 543 - DNA, 339 bp, Homo sapiens; identical to SEQ ID NO: 540

SEQ ID NO: 544 - DNA, 339 bp, Homo sapiens; identical to SEQ ID NO: 540

SEQ ID NO: 545 - DNA, 339 bp, Homo sapiens; identical to SEQ ID NO: 540

SEQ ID NO: 546 - DNA, 339 bp, Homo sapiens; identical to SEQ ID NO: 540

SEQ ID NO: 547 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgctctacttatgatggtcctggtctttctgaggtgtttggcggcggcacgaagttaaccgttcttggccag

SEQ ID NO: 548 - DNA, 339 bp, Homo sapiens; identical to SEQ ID NO: 540

SEQ ID NO: 549 - DNA, 339 bp, Homo sapiens; identical to SEQ ID NO: 547

SEQ ID NO: 550 - protein, 469 aa, Homo sapiens
MAWVWTLPFLMAAAQSVQAQVQLVESGGGLVQPGGSLRLSCAASGFTFSSYVMNWVRQAPGKGLEWVSFISGDSSNTYYADSVKGRFTISRDNSKNTLYLQMNSLRAEDTAVYYCARTFMHGHLGGGLSMDFWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 551 - protein, 462 aa, Homo sapiens
MAWVWTLPFLMAAAQSVQAQVQLVESGGGLVQPGGSLRLSCAASGFTFRSHWLSWVRQAPGKGLEWVSNINYDGSSTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 552 - protein, 469 aa, Homo sapiens; identical to SEQ ID NO: 550

SEQ ID NO: 553 - protein, 462 aa, Homo sapiens; identical to SEQ ID NO: 551

SEQ ID NO: 554 - protein, 461 aa, Homo sapiens
MAWVWTLPFLMAAAQSVQAQVQLVESGGGLVQPGGSLRLSCAASGFTFRSHWLSWVRQAPGKGLEWVSVTGVHGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 555 - protein, 461 aa, Homo sapiens
MAWVWTLPFLMAAAQSVQAQVQLVESGGGLVQPGGSLRLSCAASGFTFRSHWLSWVRQAPGKGLEWVSVIGNWGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 556 - protein, 461 aa, Homo sapiens
MAWVWTLPFLMAAAQSVQAQVQLVESGGGLVQPGGSLRLSCAASGFTFRSHWLSWVRQAPGKGLEWVSVTTHQGYTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 557 - protein, 465 aa, Homo sapiens
MKHLWFFLLLVAAPRWVLSQVQLVESGGGLVQPGGSLRLSCAASGFTFRSHWLSWVRQAPGKGLEWVSATNRYGYTYYADSVKGRFTISRDNSKNTLYLQMNSLRAEDTAVYYCARDTYLHFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 558 - protein, 462 aa, Homo sapiens; identical to SEQ ID NO: 551

SEQ ID NO: 559 - protein, 461 aa, Homo sapiens
MAWVWTLPFLMAAAQSVQAQVQLVESGGGLVQPGGSLRLSCAASGFTFRSHWLSWVRQAPGKGLEWVSVITPYGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 560 - protein, 461 aa, Homo sapiens; identical to SEQ ID NO: 559

SEQ ID NO: 561 - protein, 130 aa, Homo sapiens
MSVLTQVLALLLLWLTGTRCDIELTQPPSVSVAPGQTARISCSGDNIGSFYVHWYQQKPGQAPVLVIYDDNNRPSGIPERFSGSNSGNTATLTISGTQAEDEADYYCGSWAGSSGSYVFGGRTKLTVLGQ

SEQ ID NO: 562 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCSSYGESLTSYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 563 - protein, 234 aa, Homo sapiens
MSVLTQVLALLLLWLTGTRCDIELTQPPSVSVAPGQTARISCSGDNIGSFYVHWYQQKPGQAPVLVIYDDNNRPSGIPERFSGSNSGNTATLTISGTQAEDEADYYCASWTGVEPDYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 564 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCQSYAGSYLSEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 565 - protein, 237 aa, Homo sapiens; identical to SEQ ID NO: 562

SEQ ID NO: 566 - protein, 237 aa, Homo sapiens; identical to SEQ ID NO: 562

SEQ ID NO: 567 - protein, 237 aa, Homo sapiens; identical to SEQ ID NO: 562

SEQ ID NO: 568 - protein, 237 aa, Homo sapiens; identical to SEQ ID NO: 562

SEQ ID NO: 569 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCSTYDGPGLSEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 570 - protein, 237 aa, Homo sapiens; identical to SEQ ID NO: 562

SEQ ID NO: 571 - protein, 237 aa, Homo sapiens; identical to SEQ ID NO: 569

SEQ ID NO: 572 - DNA, 1410 bp, Homo sapiens
atggcttgggtgtggaccttgccattcctgatggcagctgcccaaagcgtgcaggcccaggtgcagctggtcgagtctggcggcggactggtgcagcctggcggcagcctgagactgagctgcgccgccagcggcttcaccttcagcagctacgtgatgaactgggtgcggcaggcccctggcaagggcctggagtgggtgtccttcatcagcggcgacagcagcaacacctactacgccgacagcgtgaagggccggttcaccatcagccgggacaacagcaagaacaccctgtacctgcagatgaacagcctgcgggccgaggacaccgccgtgtactactgcgcccggaccttcatgcacggccacctgggcggaggactgagcatggatttctggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 573 - DNA, 1389 bp, Homo sapiens
atggcttgggtgtggaccttgccattcctgatggcagctgcccaaggtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccaacatcaactacgacggcagcagcacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 574 - DNA, 1410 bp, Homo sapiens; identical to SEQ ID NO: 572

SEQ ID NO: 575 - DNA, 1389 bp, Homo sapiens
atggcttgggtgtggaccttgccattcctgatggcagctgcccaaggtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccaacatcaactacgacggcagcagcacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagagacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 576 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgaccggcgtgcacggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 577 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgatcggcaactggggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 578 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgaccacccaccagggctacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 579 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgccaccaacagatacggctacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 580 - DNA, 1389 bp, Homo sapiens; identical to SEQ ID NO: 573

SEQ ID NO: 581 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgatcaccccctacggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 582 - DNA, 1386 bp, Homo sapiens; identical to SEQ ID NO: 581

SEQ ID NO: 583 - DNA, 393 bp, Homo sapiens
atgaaaaagacagctatcgcgattgcagtggcactggctggtttcgctaccgtagcgcaggccgatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcggttcttgggctggttcttctggttcttatgtgtttggcggccgcacgaagttaaccgttcttggccag

SEQ ID NO: 584 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgcagcagctacggcgagagcctgaccagctacgtgtttggcggcggaaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 585 - DNA, 705 bp, Homo sapiens
atgagtgtgctcactcaggtcctggcgttgctgctgctgtggcttacaggtacgcgttgcgacatcgagctgacccagccccccagcgtgagcgtggcccctggccagaccgcccggatcagctgcagcggcgacaacatcggcagcttctacgtgcactggtatcagcagaagcccggccaggcccccgtgctggtgatctacgacgacaacaaccggcccagcggcatccccgagcggttcagcggcagcaacagcggcaacaccgccaccctgaccatcagcggcacccaggccgaggacgaggccgactactactgcgccagctggaccggcgtggagcccgactacgtgtttggcggcggaacaaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 586 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgccagagctacgccggcagctacctgagcgaggtgttcggcggagggaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 587 - DNA, 714 bp, Homo sapiens; identical to SEQ ID NO: 584

SEQ ID NO: 588 - DNA, 714 bp, Homo sapiens; identical to SEQ ID NO: 584

SEQ ID NO: 589 - DNA, 714 bp, Homo sapiens; identical to SEQ ID NO: 584

SEQ ID NO: 590 - DNA, 714 bp, Homo sapiens; identical to SEQ ID NO: 584

SEQ ID NO: 591 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgcagcacctacgacggccctggcctgagcgaggtgttcggcggagggaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 592 - DNA, 714 bp, Homo sapiens; identical to SEQ ID NO: 591

SEQ ID NO: 593 - DNA, 714 bp, Homo sapiens; identical to SEQ ID NO: 591

SEQ ID NO: 594 - protein, 213 aa, Homo sapiens; identical to SEQ ID NO: 397

SEQ ID NO: 595 - protein, 14 aa, Homo sapiens
ARLLNAIGRGKWWR

SEQ ID NO: 596 - protein, 15 aa, Homo sapiens
RLVASCKCKRLTRFH

SEQ ID NO: 597 - protein, 13 aa, Homo sapiens
GGGSGGGGSGGGG

SEQ ID NO: 598 - protein, 19 aa, Homo sapiens
GGGGSGGGGSGGGGSGGGG

SEQ ID NO: 599 - DNA, 21 bp, Artificial
  siRNA
taaattatcataaagtcctaa

SEQ ID NO: 600 - DNA, 21 bp, Artificial
  siRNA
aggactttatgataatttatt

SEQ ID NO: 601 - DNA, 21 bp, Artificial
  siRNA
atagtggttaaataactccag

SEQ ID NO: 602 - DNA, 21 bp, Artificial
  siRNA
ggagttatttaaccactattt

SEQ ID NO: 603 - DNA, 21 bp, Artificial
  siRNA
taaattctcgtgatgtgccat

SEQ ID NO: 604 - DNA, 21 bp, Artificial
  siRNA
ggcacatcacgagaatttatt

SEQ ID NO: 605 - DNA, 21 bp, Artificial
  siRNA
tttcttatagcacagctggtt

SEQ ID NO: 606 - DNA, 21 bp, Artificial
  siRNA
ccagctgtgctataagaaatt

SEQ ID NO: 607 - DNA, 21 bp, Artificial
  siRNA
tagacctttccatccacgctg

SEQ ID NO: 608 - DNA, 21 bp, Artificial
  siRNA
gcgtggatggaaaggtctatt

SEQ ID NO: 609 - DNA, 29 bp, Artificial
  siRNA
atgcagctcccactggccctgtgtcttgt

SEQ ID NO: 610 - DNA, 30 bp, Artificial
  siRNA
aatcaggccgagctggagaacgcctactag

SEQ ID NO: 611 - protein, 102 aa, Artificial Sequence
  KERE-class Nanobody
  misc_feature (31)..(35): CDR
  misc_feature (50)..(54): CDR
  misc_feature (87)..(91): CDR
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 612 - protein, 102 aa, Artificial Sequence
  KERE-class Nanobody
  misc_feature (31)..(35): CDR
  misc_feature (50)..(54): CDR
  misc_feature (87)..(91): CDR
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 613 - protein, 102 aa, Artificial Sequence
  KERE-class Nanobody
  misc_feature (31)..(35): CDR
  misc_feature (50)..(54): CDR
  misc_feature (87)..(91): CDR
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 614 - protein, 102 aa, Artificial Sequence
  KERE-class Nanobody
  misc_feature (31)..(35): CDR
  misc_feature (50)..(54): CDR
  misc_feature (87)..(91): CDR
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 615 - protein, 102 aa, Artificial Sequence
  KERE-class Nanobody
  misc_feature (31)..(35): CDR
  misc_feature (50)..(54): CDR
  misc_feature (87)..(91): CDR
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 616 - protein, 102 aa, Artificial Sequence
  KERE-class Nanobody
  misc_feature (31)..(35): CDR
  misc_feature (50)..(54): CDR
  misc_feature (87)..(91): CDR
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 617 - protein, 102 aa, Artificial Sequence
  KERE-class Nanobody
  misc_feature (31)..(35): CDR
  misc_feature (50)..(54): CDR
  misc_feature (87)..(91): CDR
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 618 - protein, 102 aa, Artificial Sequence
  KERE-class Nanobody
  misc_feature (31)..(35): CDR
  misc_feature (50)..(54): CDR
  misc_feature (87)..(91): CDR
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 619 - protein, 102 aa, Artificial Sequence
  KERE-class Nanobody
  misc_feature (31)..(35): CDR
  misc_feature (50)..(54): CDR
  misc_feature (87)..(91): CDR
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 620 - protein, 102 aa, Artificial Sequence
  KERE-class Nanobody
  misc_feature (31)..(35): CDR
  misc_feature (50)..(54): CDR
  misc_feature (87)..(91): CDR
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 621 - protein, 102 aa, Artificial Sequence
  KERE-class Nanobody
  misc_feature (31)..(35): CDR
  misc_feature (50)..(54): CDR
  misc_feature (87)..(91): CDR
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 622 - protein, 102 aa, Artificial Sequence
  KERE-class Nanobody
  misc_feature (31)..(35): CDR
  misc_feature (50)..(54): CDR
  misc_feature (87)..(91): CDR
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 623 - protein, 102 aa, Artificial Sequence
  KERE-class Nanobody
  misc_feature (31)..(35): CDR
  misc_feature (50)..(54): CDR
  misc_feature (87)..(91): CDR
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 624 - protein, 102 aa, Artificial Sequence
  KERE-class Nanobody
  misc_feature (31)..(35): CDR
  misc_feature (50)..(54): CDR
  misc_feature (87)..(91): CDR
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 625 - protein, 102 aa, Artificial Sequence
  KERE-class Nanobody
  misc_feature (31)..(35): CDR
  misc_feature (50)..(54): CDR
  misc_feature (87)..(91): CDR
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 626 - protein, 102 aa, Artificial Sequence
  KERE-class Nanobody
  misc_feature (31)..(35): CDR
  misc_feature (50)..(54): CDR
  misc_feature (87)..(91): CDR
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 627 - protein, 102 aa, Artificial Sequence
  GLEW-class Nanobody
  misc_feature (31)..(35): CDR
  misc_feature (50)..(54): CDR
  misc_feature (87)..(91): CDR
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 628 - protein, 102 aa, Artificial Sequence
  GLEW-class Nanobody
  misc_feature (31)..(35): CDR
  misc_feature (50)..(54): CDR
  misc_feature (87)..(91): CDR
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 629 - protein, 102 aa, Artificial Sequence
  GLEW-class Nanobody
  misc_feature (31)..(35): CDR
  misc_feature (50)..(54): CDR
  misc_feature (87)..(91): CDR
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 630 - protein, 102 aa, Artificial Sequence
  P,R,S 103-class Nanobody
  misc_feature (31)..(35): CDR
  misc_feature (50)..(54): CDR
  misc_feature (87)..(91): CDR
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 631 - protein, 102 aa, Artificial Sequence
  P,R,S 103-class Nanobody
  misc_feature (31)..(35): CDR
  misc_feature (50)..(54): CDR
  misc_feature (87)..(91): CDR
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 632 - protein, 102 aa, Artificial Sequence; identical to SEQ ID NO: 628
  P,R,S 103-class Nanobody
  misc_feature (31)..(35): CDR
  misc_feature (50)..(54): CDR
  misc_feature (87)..(91): CDR

SEQ ID NO: 633 - protein, 30 aa, Artificial Sequence
  KERE-class Nanobody FW1 sequence
QVQRVESGGGLVQAGGSLRLSCAASGRTSS

SEQ ID NO: 634 - protein, 30 aa, Artificial Sequence
  KERE-class Nanobody FW1 sequence
QVQLVESGGGLVQTGDSLSLSCSASGRTFS

SEQ ID NO: 635 - protein, 30 aa, Artificial Sequence
  KERE-class Nanobody FW1 sequence
QVKLEESGGGLVQAGDSLRLSCAATGRAFG

SEQ ID NO: 636 - protein, 30 aa, Artificial Sequence
  KERE-class Nanobody FW1 sequence
AVQLVESGGGLVQPGESLGLSCVASGRDFV

SEQ ID NO: 637 - protein, 30 aa, Artificial Sequence
  KERE-class Nanobody FW1 sequence
EVQLVESGGGLVQAGGSLRLSCEVLGRTAG

SEQ ID NO: 638 - protein, 30 aa, Artificial Sequence
  KERE-class Nanobody FW1 sequence
QVQLVESGGGWVQPGGSLRLSCAASETILS

SEQ ID NO: 639 - protein, 30 aa, Artificial Sequence
  KERE-class Nanobody FW1 sequence
QVQLVESGGGTVQPGGSLNLSCVASGNTFN

SEQ ID NO: 640 - protein, 30 aa, Artificial Sequence
  KERE-class Nanobody FW1 sequence
EVQLVESGGGLAQPGGSLQLSCSAPGFTLD

SEQ ID NO: 641 - protein, 30 aa, Artificial Sequence
  KERE-class Nanobody FW1 sequence
AQELEESGGGLVQAGGSLRLSCAASGRTFN

SEQ ID NO: 642 - protein, 22 aa, Artificial Sequence
  KERE-class Nanobody FW1 sequence
VESGGGLVQPGGSLRLSCAASG

SEQ ID NO: 643 - protein, 22 aa, Artificial Sequence
  KERE-class Nanobody FW1 sequence
VDSGGGLVQAGDSLKLSCALTG

SEQ ID NO: 644 - protein, 22 aa, Artificial Sequence
  KERE-class Nanobody FW1 sequence
VDSGGGLVQAGDSLRLSCAASG

SEQ ID NO: 645 - protein, 22 aa, Artificial Sequence
  KERE-class Nanobody FW1 sequence
VDSGGGLVEAGGSLRLSCQVSE

SEQ ID NO: 646 - protein, 22 aa, Artificial Sequence
  KERE-class Nanobody FW1 sequence
QDSGGGSVQAGGSLKLSCAASG

SEQ ID NO: 647 - protein, 22 aa, Artificial Sequence
  KERE-class Nanobody FW1 sequence
VQSGGRLVQAGDSLRLSCAASE

SEQ ID NO: 648 - protein, 22 aa, Artificial Sequence
  KERE-class Nanobody FW1 sequence
VESGGTLVQSGDSLKLSCASST

SEQ ID NO: 649 - protein, 22 aa, Artificial Sequence
  KERE-class Nanobody FW1 sequence
MESGGDSVQSGGSLTLSCVASG

SEQ ID NO: 650 - protein, 22 aa, Artificial Sequence
  KERE-class Nanobody FW1 sequence
QASGGGLVQAGGSLRLSCSASV

SEQ ID NO: 651 - protein, 14 aa, Artificial Sequence
  KERE-class Nanobody FW2 sequence
WFRQAPGKEREFVA

SEQ ID NO: 652 - protein, 14 aa, Artificial Sequence
  KERE-class Nanobody FW2 sequence
WFRQTPGREREFVA

SEQ ID NO: 653 - protein, 14 aa, Artificial Sequence
  KERE-class Nanobody FW2 sequence
WYRQAPGKQREMVA

SEQ ID NO: 654 - protein, 14 aa, Artificial Sequence
  KERE-class Nanobody FW2 sequence
WYRQGPGKQRELVA

SEQ ID NO: 655 - protein, 14 aa, Artificial Sequence
  KERE-class Nanobody FW2 sequence
WIRQAPGKEREGVS

SEQ ID NO: 656 - protein, 14 aa, Artificial Sequence
  KERE-class Nanobody FW2 sequence
WFREAPGKEREGIS

SEQ ID NO: 657 - protein, 14 aa, Artificial Sequence
  KERE-class Nanobody FW2 sequence
WYRQAPGKERDLVA

SEQ ID NO: 658 - protein, 14 aa, Artificial Sequence
  KERE-class Nanobody FW2 sequence
WFRQAPGKQREEVS

SEQ ID NO: 659 - protein, 14 aa, Artificial Sequence
  KERE-class Nanobody FW2 sequence
WFRQPPGKVREFVG

SEQ ID NO: 660 - protein, 32 aa, Artificial Sequence
  KERE-class Nanobody FW3 sequence
RFTISRDNAKNTVYLQMNSLKPEDTAVYRCYF

SEQ ID NO: 661 - protein, 32 aa, Artificial Sequence
  KERE-class Nanobody FW3 sequence
RFAISRDNNKNTGYLQMNSLEPEDTAVYYCAA

SEQ ID NO: 662 - protein, 32 aa, Artificial Sequence
  KERE-class Nanobody FW3 sequence
RFTVARNNAKNTVNLEMNSLKPEDTAVYYCAA

SEQ ID NO: 663 - protein, 32 aa, Artificial Sequence
  KERE-class Nanobody FW3 sequence
RFTISRDIAKNTVDLLMNNLEPEDTAVYYCAA

SEQ ID NO: 664 - protein, 32 aa, Artificial Sequence
  KERE-class Nanobody FW3 sequence
RLTISRDNAVDTMYLQMNSLKPEDTAVYYCAA

SEQ ID NO: 665 - protein, 32 aa, Artificial Sequence
  KERE-class Nanobody FW3 sequence
RFTISRDNAKNTVYLQMDNVKPEDTAIYYCAA

SEQ ID NO: 666 - protein, 32 aa, Artificial Sequence
  KERE-class Nanobody FW3 sequence
RFTISKDSGKNTVYLQMTSLKPEDTAVYYCAT

SEQ ID NO: 667 - protein, 32 aa, Artificial Sequence
  KERE-class Nanobody FW3 sequence
RFTISRDSAKNMMYLQMNNLKPQDTAVYYCAA

SEQ ID NO: 668 - protein, 32 aa, Artificial Sequence
  KERE-class Nanobody FW3 sequence
RFTISRENDKSTVYLQLNSLKPEDTAVYYCAA

SEQ ID NO: 669 - protein, 32 aa, Artificial Sequence
  KERE-class Nanobody FW3 sequence
RFTISRDYAGNTAYLQMNSLKPEDTGVYYCAT

SEQ ID NO: 670 - protein, 11 aa, Artificial Sequence
  KERE-class Nanobody FW4 sequence
WGQGTQVTVSS

SEQ ID NO: 671 - protein, 11 aa, Artificial Sequence
  KERE-class Nanobody FW4 sequence
WGKGTLVTVSS

SEQ ID NO: 672 - protein, 11 aa, Artificial Sequence
  KERE-class Nanobody FW4 sequence
RGQGTRVTVSS

SEQ ID NO: 673 - protein, 11 aa, Artificial Sequence
  KERE-class Nanobody FW4 sequence
WGLGTQVTISS

SEQ ID NO: 674 - protein, 30 aa, Artificial Sequence
  GLEW-class Nanobody FW1 sequence
QVQLVESGGGLVQPGGSLRLSCAASGFTFS

SEQ ID NO: 675 - protein, 30 aa, Artificial Sequence
  GLEW-class Nanobody FW1 sequence
EVHLVESGGGLVRPGGSLRLSCAAFGFIFK

SEQ ID NO: 676 - protein, 30 aa, Artificial Sequence
  GLEW-class Nanobody FW1 sequence
QVKLEESGGGLAQPGGSLRLSCVASGFTFS

SEQ ID NO: 677 - protein, 30 aa, Artificial Sequence
  GLEW-class Nanobody FW1 sequence
EVQLVESGGGLVQPGGSLRLSCVCVSSGCT

SEQ ID NO: 678 - protein, 30 aa, Artificial Sequence
  GLEW-class Nanobody FW1 sequence
EVQLVESGGGLALPGGSLTLSCVFSGSTFS

SEQ ID NO: 679 - protein, 22 aa, Artificial Sequence
  GLEW-class Nanobody FW1 sequence
VESGGGLVQPGGSLRLSCAASG

SEQ ID NO: 680 - protein, 22 aa, Artificial Sequence
  GLEW-class Nanobody FW1 sequence
EESGGGLAQPGGSLRLSCVASG

SEQ ID NO: 681 - protein, 22 aa, Artificial Sequence
  GLEW-class Nanobody FW1 sequence
VESGGGLALPGGSLTLSCVFSG

SEQ ID NO: 682 - protein, 14 aa, Artificial Sequence
  GLEW-class Nanobody FW2 sequence
WVRQAPGKVLEWVS

SEQ ID NO: 683 - protein, 14 aa, Artificial Sequence
  GLEW-class Nanobody FW2 sequence
WVRRPPGKGLEWVS

SEQ ID NO: 684 - protein, 14 aa, Artificial Sequence
  GLEW-class Nanobody FW2 sequence
WVRQAPGMGLEWVS

SEQ ID NO: 685 - protein, 14 aa, Artificial Sequence
  GLEW-class Nanobody FW2 sequence
WVRQAPGKEPEWVS

SEQ ID NO: 686 - protein, 14 aa, Artificial Sequence
  GLEW-class Nanobody FW2 sequence
WVRQAPGKDQEWVS

SEQ ID NO: 687 - protein, 14 aa, Artificial Sequence
  GLEW-class Nanobody FW2 sequence
WVRQAPGKAEEWVS

SEQ ID NO: 688 - protein, 14 aa, Artificial Sequence
  GLEW-class Nanobody FW2 sequence
WVRQAPGKGLEWVA

SEQ ID NO: 689 - protein, 14 aa, Artificial Sequence
  GLEW-class Nanobody FW2 sequence
WVRQAPGRATEWVS

SEQ ID NO: 690 - protein, 32 aa, Artificial Sequence
  GLEW-class Nanobody FW3 sequence
RFTISRDNAKNTLYLQMNSLKPEDTAVYYCVK

SEQ ID NO: 691 - protein, 32 aa, Artificial Sequence
  GLEW-class Nanobody FW3 sequence
RFTISRDNARNTLYLQMDSLIPEDTALYYCAR

SEQ ID NO: 692 - protein, 32 aa, Artificial Sequence
  GLEW-class Nanobody FW3 sequence
RFTSSRDNAKSTLYLQMNDLKPEDTALYYCAR

SEQ ID NO: 693 - protein, 32 aa, Artificial Sequence
  GLEW-class Nanobody FW3 sequence
RFIISRDNAKNTLYLQMNSLGPEDTAMYYCQR

SEQ ID NO: 694 - protein, 32 aa, Artificial Sequence
  GLEW-class Nanobody FW3 sequence
RFTASRDNAKNTLYLQMNSLKSEDTARYYCAR

SEQ ID NO: 695 - protein, 32 aa, Artificial Sequence
  GLEW-class Nanobody FW3 sequence
RFTISRDNAKNTLYLQMDDLQSEDTAMYYCGR

SEQ ID NO: 696 - protein, 11 aa, Artificial Sequence
  GLEW-class Nanobody FW4 sequence
GSQGTQVTVSS

SEQ ID NO: 697 - protein, 11 aa, Artificial Sequence
  GLEW-class Nanobody FW4 sequence
LRGGTQVTVSS

SEQ ID NO: 698 - protein, 11 aa, Artificial Sequence
  GLEW-class Nanobody FW4 sequence
RGQGTLVTVSS

SEQ ID NO: 699 - protein, 11 aa, Artificial Sequence
  GLEW-class Nanobody FW4 sequence
RSRGIQVTVSS

SEQ ID NO: 700 - protein, 11 aa, Artificial Sequence
  GLEW-class Nanobody FW4 sequence
WGKGTQVTVSS

SEQ ID NO: 701 - protein, 11 aa, Artificial Sequence
  GLEW-class Nanobody FW4 sequence
WGQGTQVTVSS

SEQ ID NO: 702 - protein, 30 aa, Artificial Sequence
  P,R,S 103-class Nanobody FW1 sequence
AVQLVESGGGLVQAGGSLRLSCAASGRTFS

SEQ ID NO: 703 - protein, 30 aa, Artificial Sequence
  P,R,S 103-class Nanobody FW1 sequence
QVQLQESGGGMVQPGGSLRLSCAASGFDFG

SEQ ID NO: 704 - protein, 30 aa, Artificial Sequence; identical to SEQ ID NO: 675
  P,R,S 103-class Nanobody FW1 sequence

SEQ ID NO: 705 - protein, 30 aa, Artificial Sequence
  P,R,S 103-class Nanobody FW1 sequence
QVQLAESGGGLVQPGGSLKLSCAASRTIVS

SEQ ID NO: 706 - protein, 30 aa, Artificial Sequence
  P,R,S 103-class Nanobody FW1 sequence
QEHLVESGGGLVDIGGSLRLSCAASERIFS

SEQ ID NO: 707 - protein, 30 aa, Artificial Sequence; identical to SEQ ID NO: 676
  P,R,S 103-class Nanobody FW1 sequence

SEQ ID NO: 708 - protein, 30 aa, Artificial Sequence; identical to SEQ ID NO: 677
  P,R,S 103-class Nanobody FW1 sequence

SEQ ID NO: 709 - protein, 30 aa, Artificial Sequence; identical to SEQ ID NO: 678
  P,R,S 103-class Nanobody FW1 sequence

SEQ ID NO: 710 - protein, 22 aa, Artificial Sequence
  P,R,S 103-class Nanobody FW1 sequence
VESGGGLVQAGGSLRLSCAASG

SEQ ID NO: 711 - protein, 22 aa, Artificial Sequence
  P,R,S 103-class Nanobody FW1 sequence
AESGGGLVQPGGSLKLSCAASR

SEQ ID NO: 712 - protein, 14 aa, Artificial Sequence
  P,R,S 103-class Nanobody FW2 sequence
WFRQAPGKEREFVA

SEQ ID NO: 713 - protein, 14 aa, Artificial Sequence
  P,R,S 103-class Nanobody FW2 sequence
WVRQAPGKVLEWVS

SEQ ID NO: 714 - protein, 14 aa, Artificial Sequence
  P,R,S 103-class Nanobody FW2 sequence
WVRRPPGKGLEWVS

SEQ ID NO: 715 - protein, 14 aa, Artificial Sequence
  P,R,S 103-class Nanobody FW2 sequence
WIRQAPGKEREGVS

SEQ ID NO: 716 - protein, 14 aa, Artificial Sequence
  P,R,S 103-class Nanobody FW2 sequence
WVRQYPGKEPEWVS

SEQ ID NO: 717 - protein, 14 aa, Artificial Sequence
  P,R,S 103-class Nanobody FW2 sequence
WFRQPPGKEHEFVA

SEQ ID NO: 718 - protein, 14 aa, Artificial Sequence
  P,R,S 103-class Nanobody FW2 sequence
WYRQAPGKRTELVA

SEQ ID NO: 719 - protein, 14 aa, Artificial Sequence
  P,R,S 103-class Nanobody FW2 sequence
WLRQAPGQGLEWVS

SEQ ID NO: 720 - protein, 14 aa, Artificial Sequence
  P,R,S 103-class Nanobody FW2 sequence
WLRQTPGKGLEWVG

SEQ ID NO: 721 - protein, 14 aa, Artificial Sequence
  P,R,S 103-class Nanobody FW2 sequence
WVRQAPGKAEEFVS

SEQ ID NO: 722 - protein, 32 aa, Artificial Sequence
  P,R,S 103-class Nanobody FW3 sequence
RFTISRDNAKNTVYLQMNSLKPEDTAVYYCAA

SEQ ID NO: 723 - protein, 32 aa, Artificial Sequence; identical to SEQ ID NO: 691
  P,R,S 103-class Nanobody FW3 sequence

SEQ ID NO: 724 - protein, 32 aa, Artificial Sequence
  P,R,S 103-class Nanobody FW3 sequence
RFTISRDNAKNEMYLQMNNLKTEDTGVYWCGA

SEQ ID NO: 725 - protein, 32 aa, Artificial Sequence
  P,R,S 103-class Nanobody FW3 sequence
RFTISSDSNRNMIYLQMNNLKPEDTAVYYCAA

SEQ ID NO: 726 - protein, 32 aa, Artificial Sequence
  P,R,S 103-class Nanobody FW3 sequence
RFTISRDNAKNMLYLHLNNLKSEDTAVYYCRR

SEQ ID NO: 727 - protein, 32 aa, Artificial Sequence
  P,R,S 103-class Nanobody FW3 sequence
RFTISRDNAKKTVYLRLNSLNPEDTAVYSCNL

SEQ ID NO: 728 - protein, 32 aa, Artificial Sequence
  P,R,S 103-class Nanobody FW3 sequence
RFKISRDNAKKTLYLQMNSLGPEDTAMYYCQR

SEQ ID NO: 729 - protein, 32 aa, Artificial Sequence
  P,R,S 103-class Nanobody FW3 sequence
RFTVSRDNGKNTAYLRMNSLKPEDTADYYCAV

SEQ ID NO: 730 - protein, 11 aa, Artificial Sequence
  P,R,S 103-class Nanobody FW4 sequence
RGQGTQVTVSS

SEQ ID NO: 731 - protein, 11 aa, Artificial Sequence
  P,R,S 103-class Nanobody FW4 sequence
LRGGTQVTVSS

SEQ ID NO: 732 - protein, 11 aa, Artificial Sequence
  P,R,S 103-class Nanobody FW4 sequence
GNKGTLVTVSS

SEQ ID NO: 733 - protein, 11 aa, Artificial Sequence
  P,R,S 103-class Nanobody FW4 sequence
SSPGTQVTVSS

SEQ ID NO: 734 - protein, 11 aa, Artificial Sequence
  P,R,S 103-class Nanobody FW4 sequence
SSQGTLVTVSS

SEQ ID NO: 735 - protein, 11 aa, Artificial Sequence
  P,R,S 103-class Nanobody FW4 sequence
RSRGIQVTVSS

SEQ ID NO: 736 - protein, 30 aa, Artificial Sequence
  FR1 sequence
EVQLVESGGGLVQPGGSLRLSCAASGSIFS

SEQ ID NO: 737 - protein, 30 aa, Artificial Sequence
  FR1 sequence
EVQLVESGGGLVQAGDSLRLSCTATGRTSS

SEQ ID NO: 738 - protein, 30 aa, Artificial Sequence
  FR1 sequence
EVQLVESGGGLVQAGGSLRLSCATSGFTFS

SEQ ID NO: 739 - protein, 30 aa, Artificial Sequence
  FR1 sequence
KVQLVESGGGLVQAGGSLRLSCAASGRTFS

SEQ ID NO: 740 - protein, 30 aa, Artificial Sequence
  FR1 sequence
EVQLVESGGGLVQAGDSLRLSCAATGRTSS

SEQ ID NO: 741 - protein, 30 aa, Artificial Sequence
  FR1 sequence
EVQLVESGGGLVQAGGSLRLSCVASGRTLR

SEQ ID NO: 742 - protein, 30 aa, Artificial Sequence
  FR1 sequence
EVQLVESGGGLVQAGGSLRLTCAASGRTFS

SEQ ID NO: 743 - protein, 30 aa, Artificial Sequence
  FR1 sequence
EVQLVESGGGLVQAGGSLRLSCAASGLTFN

SEQ ID NO: 744 - protein, 30 aa, Artificial Sequence; identical to SEQ ID NO: 740
  FR1 sequence

SEQ ID NO: 745 - protein, 5 aa, Artificial Sequence
  CDR sequence
DNVMG

SEQ ID NO: 746 - protein, 5 aa, Artificial Sequence
  CDR sequence
IYNMD

SEQ ID NO: 747 - protein, 5 aa, Artificial Sequence
  CDR sequence
RFDMS

SEQ ID NO: 748 - protein, 5 aa, Artificial Sequence
  CDR sequence
SYFMG

SEQ ID NO: 749 - protein, 5 aa, Artificial Sequence
  CDR sequence
IYNMD

SEQ ID NO: 750 - protein, 5 aa, Artificial Sequence
  CDR sequence
RYVTG

SEQ ID NO: 751 - protein, 5 aa, Artificial Sequence
  CDR sequence
SFVIG

SEQ ID NO: 752 - protein, 5 aa, Artificial Sequence
  CDR sequence
QYTIT

SEQ ID NO: 753 - protein, 5 aa, Artificial Sequence
  CDR sequence
IYNMD

SEQ ID NO: 754 - protein, 14 aa, Artificial Sequence
  FR2 sequence
WYRQAPGKQRELVA

SEQ ID NO: 755 - protein, 14 aa, Artificial Sequence
  FR2 sequence
WFRQTPGKERELIA

SEQ ID NO: 756 - protein, 14 aa, Artificial Sequence
  FR2 sequence
WFRQAPGKQREFIA

SEQ ID NO: 757 - protein, 14 aa, Artificial Sequence
  FR2 sequence
WFRQAPGKEREVVA

SEQ ID NO: 758 - protein, 14 aa, Artificial Sequence
  FR2 sequence
WFLQAPGKERELIA

SEQ ID NO: 759 - protein, 14 aa, Artificial Sequence
  FR2 sequence
WFRQAPGKEREVVA

SEQ ID NO: 760 - protein, 14 aa, Artificial Sequence
  FR2 sequence
WFRQAPGKQREVVA

SEQ ID NO: 761 - protein, 14 aa, Artificial Sequence
  FR2 sequence
WFRQAPGKEREFVA

SEQ ID NO: 762 - protein, 14 aa, Artificial Sequence
  FR2 sequence
WFRQGSGKGRELIA

SEQ ID NO: 763 - protein, 16 aa, Artificial Sequence
  CDR sequence
TIWSSGHTNYADSVKG

SEQ ID NO: 764 - protein, 17 aa, Artificial Sequence
  CDR sequence
RLWWRSGSTYYADSVKG

SEQ ID NO: 765 - protein, 16 aa, Artificial Sequence
  CDR sequence
TIFSGGDTDYIDSVKG

SEQ ID NO: 766 - protein, 17 aa, Artificial Sequence
  CDR sequence
TIRWSDGSTYYEDSVKG

SEQ ID NO: 767 - protein, 17 aa, Artificial Sequence
  CDR sequence
RIWWRSGATYYADSVKG

SEQ ID NO: 768 - protein, 17 aa, Artificial Sequence
  CDR sequence
SISWSGESTYYADSVKG

SEQ ID NO: 769 - protein, 16 aa, Artificial Sequence
  CDR sequence
SITSGGSTYYEDSGKG

SEQ ID NO: 770 - protein, 17 aa, Artificial Sequence
  CDR sequence
AVSWSGSSESVSNSVKG

SEQ ID NO: 771 - protein, 17 aa, Artificial Sequence
  CDR sequence
RIWWRSGETYYADSVKG

SEQ ID NO: 772 - protein, 32 aa, Artificial Sequence
  FR3 sequence
RFTISRDNAKNTVYLQMNSLKPEDTAVYYCNL

SEQ ID NO: 773 - protein, 32 aa, Artificial Sequence
  FR3 sequence
RFTISRDNAKNTVYLQMNSLKPEDTSVYICTA

SEQ ID NO: 774 - protein, 32 aa, Artificial Sequence
  FR3 sequence
RFTISRDNAKNTVYLQMNSLKPEDTAVYYCCP

SEQ ID NO: 775 - protein, 32 aa, Artificial Sequence; identical to SEQ ID NO: 722
  FR3 sequence

SEQ ID NO: 776 - protein, 32 aa, Artificial Sequence
  FR3 sequence
RFTISRGNAKNTVYLQMNSLKPEDTGVYHCTA

SEQ ID NO: 777 - protein, 32 aa, Artificial Sequence
  FR3 sequence
RFAISRDNAKNAVYLQMNSLNLEDTGVYYCAE

SEQ ID NO: 778 - protein, 32 aa, Artificial Sequence
  FR3 sequence
RFTISRDNAKNRVYLQMNSLRPEDTAVYYCAA

SEQ ID NO: 779 - protein, 32 aa, Artificial Sequence
  FR3 sequence
RFTISRDNAKNTAYLAMNSLKPEDTAVYYCAA

SEQ ID NO: 780 - protein, 32 aa, Artificial Sequence
  FR3 sequence
RFTISRDNAKNTVYLQMNSLKPEDTNVYHCAA

SEQ ID NO: 781 - protein, 12 aa, Artificial Sequence
  CDR sequence
GTIVTGTWRSDY

SEQ ID NO: 782 - protein, 10 aa, Artificial Sequence
  CDR sequence
GDTGGAAYGY

SEQ ID NO: 783 - protein, 6 aa, Artificial Sequence
  CDR sequence
LGIEYA

SEQ ID NO: 784 - protein, 9 aa, Artificial Sequence
  CDR sequence
AKGIGVYGY

SEQ ID NO: 785 - protein, 10 aa, Artificial Sequence
  CDR sequence
GVTGGAAYGY

SEQ ID NO: 786 - protein, 9 aa, Artificial Sequence
  CDR sequence
AELPGTYDY

SEQ ID NO: 787 - protein, 9 aa, Artificial Sequence
  CDR sequence
AEPAGVYDV

SEQ ID NO: 788 - protein, 15 aa, Artificial Sequence
  CDR sequence
DRRGLASTRAADYDY

SEQ ID NO: 789 - protein, 10 aa, Artificial Sequence
  CDR sequence
GDTGGASYGY

SEQ ID NO: 790 - protein, 11 aa, Artificial Sequence
  FR4 sequence
WGQGTQVTVSS

SEQ ID NO: 791 - protein, 11 aa, Artificial Sequence
  FR4 sequence
WGQGTQVTVSS

SEQ ID NO: 792 - protein, 11 aa, Artificial Sequence
  FR4 sequence
WGQGTQVTVSS

SEQ ID NO: 793 - protein, 11 aa, Artificial Sequence
  FR4 sequence
WGQGTQVTVSS

SEQ ID NO: 794 - protein, 11 aa, Artificial Sequence
  FR4 sequence
WGQGTQVTVSS

SEQ ID NO: 795 - protein, 11 aa, Artificial Sequence
  FR4 sequence
WGQGTQVTVSS

SEQ ID NO: 796 - protein, 11 aa, Artificial Sequence
  FR4 sequence
WGQGTQVTVSS

SEQ ID NO: 797 - protein, 11 aa, Artificial Sequence
  FR4 sequence
WGQGTQVTVSS

SEQ ID NO: 798 - protein, 11 aa, Artificial Sequence
  FR4 sequence
WGQGTQVTVSS

SEQ ID NO: 799 - protein, 120 aa, Artificial Sequence
  Nanobody
EVQLVESGGGLVQPGGSLRLSCAASGSIFSDNVMGWYRQAPGKQRELVATIWSSGHTNYADSVKGRFTISRDNAKNTVYLQMNSLKPEDTAVYYCNLGTIVTGTWRSDYWGQGTQVTVSS

SEQ ID NO: 800 - protein, 119 aa, Artificial Sequence
  Nanobody
EVQLVESGGGLVQAGDSLRLSCTATGRTSSIYNMDWFRQTPGKERELIARLWWRSGSTYYADSVKGRFTISRDNAKNTVYLQMNSLKPEDTSVYICTAGDTGGAAYGYWGQGTQVTVSS

SEQ ID NO: 801 - protein, 114 aa, Artificial Sequence
  Nanobody
EVQLVESGGGLVQAGGSLRLSCATSGFTFSRFDMSWFRQAPGKQREFIATIFSGGDTDYIDSVKGRFTISRDNAKNTVYLQMNSLKPEDTAVYYCCPLGIEYAWGQGTQVTVSS

SEQ ID NO: 802 - protein, 118 aa, Artificial Sequence
  Nanobody
KVQLVESGGGLVQAGGSLRLSCAASGRTFSSYFMGWFRQAPGKEREVVATIRWSDGSTYYEDSVKGRFTISRDNAKNTVYLQMNSLKPEDTAVYYCAAAKGIGVYGYWGQGTQVTVSS

SEQ ID NO: 803 - protein, 119 aa, Artificial Sequence
  Nanobody
EVQLVESGGGLVQAGDSLRLSCAATGRTSSIYNMDWFLQAPGKERELIARIWWRSGATYYADSVKGRFTISRGNAKNTVYLQMNSLKPEDTGVYHCTAGVTGGAAYGYWGQGTQVTVSS

SEQ ID NO: 804 - protein, 118 aa, Artificial Sequence
  Nanobody
EVQLVESGGGLVQAGGSLRLSCVASGRTLRRYVTGWFRQAPGKEREVVASISWSGESTYYADSVKGRFAISRDNAKNAVYLQMNSLNLEDTGVYYCAEAELPGTYDYWGQGTQVTVSS

SEQ ID NO: 805 - protein, 117 aa, Artificial Sequence
  Nanobody
EVQLVESGGGLVQAGGSLRLTCAASGRTFSSFVIGWFRQAPGKQREVVASITSGGSTYYEDSGKGRFTISRDNAKNRVYLQMNSLRPEDTAVYYCAAAEPAGVYDVWGQGTQVTVSS

SEQ ID NO: 806 - protein, 124 aa, Artificial Sequence
  Nanobody
EVQLVESGGGLVQAGGSLRLSCAASGLTFNQYTITWFRQAPGKEREFVAAVSWSGSSESVSNSVKGRFTISRDNAKNTAYLAMNSLKPEDTAVYYCAADRRGLASTRAADYDYWGQGTQVTVSS

SEQ ID NO: 807 - protein, 119 aa, Artificial Sequence
  Nanobody
EVQLVESGGGLVQAGDSLRLSCAATGRTSSIYNMDWFRQGSGKGRELIARIWWRSGETYYADSVKGRFTISRDNAKNTVYLQMNSLKPEDTNVYHCAAGDTGGASYGYWGQGTQVTVSS

SEQ ID NO: 808 - protein, 213 aa, Homo sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQTVQLLCPGGEAPRARKVRLVASCKCKRLTRFHNQSELKDFGTEAARPQKGRKPRPRARSAKANQAELENAY

SEQ ID NO: 809 - protein, 213 aa, Artificial Sequence
  Recombinant sclerostin
MPLLLLLPLLWAGALAHHHHHHHQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

The invention claimed is:

1. A method for treating a bone disorder associated with at least one of low bone formation, low bone mineral density, low bone mineral content, low bone mass, low bone quality and low bone strength in a mammalian subject, which method comprises:
   (a) administering a batch of at least five doses of anti-sclerostin antibody to a subject in need of such treatment, wherein the doses in the batch are administered at about monthly intervals, and monitoring the subject to identify a reduced response to a dose of the anti-sclerostin antibody;
   (b) then allowing the subject a dosing holiday, which is at least twelve months in length; and
   (c) administering to the subject a further batch of at least five doses of anti-sclerostin antibody after the dosing holiday of (b), wherein the doses in the further batch are administered at about monthly intervals.

2. The method of claim 1, where the method further comprises:
   (d) monitoring the subject to identify a reduced response to a dose of the anti-sclerostin antibody, and allowing the subject a further dosing holiday at least twelve months in length; and
   (e) administering to the subject a further batch of at least five doses of anti-sclerostin antibody after the dosing holiday of step (d).

3. The method of claim 1, wherein: the batch of doses in step (a) comprises from five to twelve doses of anti-sclerostin antibody.

4. The method of claim 3, wherein: the batch of doses in step (a) comprises from five to seven doses of anti-sclerostin antibody.

5. The method of claim 1, wherein the batch of doses in step (a) comprises twelve doses, with the doses given at monthly intervals.

6. The method of claim 1, wherein the subject is administered a batch of from five to twelve doses of anti-sclerostin antibody in step (c).

7. The method of claim 1, where the monitoring is performed using:
   (a) a marker of bone resorption selected from the group consisting of C-telopeptide, N-telopeptide, deoxypyridinoline, pyridinoline, urinary hydroxyproline, galactosyl hydroxylysine, and tartrate-resistant acid phosphatase;
   (b) a marker of bone formation and/or mineralization selected from the group consisting of bone-specific alkaline phosphatase, peptides released from N- and C-terminal extension of type I procollagen, and osteocalcin;
   (c) assessing bone mineral content and/or bone density using a technique selected from the group consisting of single- and dual-energy X-ray absorptiometry, ultrasound, computed tomography, radiography, and magnetic resonance imaging; or
   (d) any combination of the foregoing.

8. The method of claim 1, wherein step (b) further comprises administering a different treatment for the bone disorder during the dosing holiday.

9. The method of claim 8 where the different treatment is an anti-resorptive.

10. The method of claim 8, wherein the different treatment is bisphosphonate.

11. The method of claim 8 wherein the different treatment is denosumab.

12. The method of claim 8 where the subject is one who has also been administered the different treatment prior to step (a).

13. The method of claim 1, wherein the anti-sclerostin antibody demonstrates a binding affinity for sclerostin of SEQ ID NO: 1 of less than or equal to $1\times10^{-7}$ M, where said anti-sclerostin antibody binds to the sequence of SEQ ID NO: 6.

14. The method of claim 1, wherein the anti-sclerostin antibody demonstrates a binding affinity for sclerostin of SEQ ID NO: 1 of less than or equal to $1\times10^{-7}$ M, wherein the anti-sclerostin antibody binds the sequence of at least one of SEQ ID NO: 2, SEQ ID NO: 3, SEQ ID NO: 4, or SEQ ID NO: 5.

15. The method of claim 14, wherein the anti-sclerostin antibody binds a fragment of sclerostin of SEQ ID NO: 1 consisting of SEQ ID NO: 2, SEQ ID NO: 3, SEQ ID NO: 4, and SEQ ID NO: 5.

16. The method of claim 1, wherein the anti-sclerostin antibody cross-blocks the binding of at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, or Ab-24 to sclerostin and/or is cross-blocked from binding to sclerostin by at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, or Ab-24.

17. The method of claim 1, wherein the anti-sclerostin antibody demonstrates a binding affinity for sclerostin of SEQ ID NO: 1 of less than or equal to $1\times10^{-7}$ M and comprises a CDR-H1 of SEQ ID NO:245, a CDR-H2 of SEQ ID NO:246, a CDR-H3 of SEQ ID NO:247, a CDR-L1 of SEQ ID NO:78, a CDR-L2 of SEQ ID NO:79 and a CDR-L3 of SEQ ID NO:80.

18. The method of claim 17, wherein the anti-sclerostin antibody comprises heavy chains comprising SEQ ID NO: 378 and light chains comprising SEQ ID NO 376.

19. The method of claim 17, wherein the anti-sclerostin antibody comprises heavy chains of SEQ ID NO: 145 or SEQ ID NO: 392 and light chains of SEQ ID NO: 141.

20. The method of claim 8, wherein the anti-sclerostin antibody demonstrates a binding affinity for sclerostin of SEQ ID NO: 1 of less than or equal to $1 \times 10^{-7}$ M and comprises a CDR-H1 of SEQ ID NO:245, a CDR-H2 of SEQ ID NO:246, a CDR-H3 of SEQ ID NO:247, a CDR-L1 of SEQ ID NO:78, a CDR-L2 of SEQ ID NO:79 and a CDR-L3 of SEQ ID NO:80.

21. The method of claim 20, wherein the anti-sclerostin antibody comprises heavy chains comprising SEQ ID NO: 378 and light chains comprising SEQ ID NO 376.

22. The method of claim 20, wherein the anti-sclerostin antibody comprises heavy chains of SEQ ID NO: 145 or SEQ ID NO: 392 and light chains of SEQ ID NO: 141.

23. The method of claim 1, wherein the amount of anti-sclerostin antibody administered for each dose is from about 50 to 250 mg.

24. The method of claim 1, wherein the amount of anti-sclerostin antibody administered for each dose is about 70 mg.

25. The method of claim 1, wherein the amount of anti-sclerostin antibody administered for each dose is about 140 mg.

26. The method of claim 25, wherein the amount of anti-sclerostin antibody administered for each dose is about 210 mg.

27. The method of claim 1, wherein the subject has osteoporosis or osteopenia.

28. The method of claim 17, wherein the subject is a postmenopausal woman.

29. The method of claim 20, wherein the subject is a postmenopausal woman.

30. A method for treating a bone disorder associated with at least one of low bone formation, low bone mineral density, low bone mineral content, low bone mass, low bone quality and low bone strength in a mammalian subject, which method comprises:
    (a) administering a batch of at least five doses of anti-sclerostin antibody to a subject in need of such treatment, and monitoring the subject to identify whether the subject shows a reduced response to a dose of the anti-sclerostin antibody;
    (b) if such a reduced response is identified, allowing the subject a dosing holiday which is at least twelve months in length; and
    (c) if a dosing holiday is given in (b), administering to the subject a further batch of at least five dose of anti-sclerostin antibody after the dosing holiday of (b).

31. The method of claim 30, wherein:
    (i) the subject is known to have been administered at least two doses of anti-sclerostin antibody prior to step (a);
    (ii) the subject is one considered to be likely to display reduced responsiveness to the anti-sclerostin antibody due to previous administration of the antibody; or
    (iii) a combination of the foregoing.

32. The method of claim 30, wherein the monitoring is performed using:
    (a) a marker of bone resorption selected from the group consisting of C-telopeptide, N-telopeptide, deoxypyridinoline, pyridinoline, urinary hydroxyproline, galactosyl hydroxylysine, and tartrate-resistant acid phosphatase;
    (b) a marker of bone formation and/or mineralization selected from the group consisting of bone-specific alkaline phosphatase, peptides released from N- and C-terminal extension of type I procollagen, and osteocalcin;
    (c) assessing bone mineral content and/or bone density using a technique selected from the group consisting of single- and dual-energy X-ray absorptiometry, ultrasound, computed tomography, radiography, and magnetic resonance imaging; or
    (d) any combination of the foregoing.

33. A method for treating osteoporosis in a postmenopausal woman, which method comprises:
    (a) administering a batch of at least five doses of an anti-sclerostin antibody to the woman at about monthly intervals, and monitoring the woman to identify a reduced response to a dose of the anti-sclerostin antibody;
    (b) then allowing the woman a dosing holiday of at least twelve months; and
    (c) administering to the woman a further batch of at least five doses of anti-sclerostin antibody after the dosing holiday of (b).

34. The method of claim 33, wherein step (a) comprises twelve doses given at about monthly intervals.

35. The method of claim 33, wherein step (c) comprises twelve doses given at about monthly intervals.

36. The method of claim 33, wherein during the dosing holiday, the woman is administered a different treatment for osteoporosis.

37. The method of claim 36, wherein the different treatment is bisphosphonate.

38. The method of claim 36, wherein the different treatment is denosumab.

39. The method of claim 33, wherein each dose of the anti-sclerostin antibody is 210 mg.

* * * * *